US009783780B2

(12) United States Patent
Kühn et al.

(10) Patent No.: US 9,783,780 B2
(45) Date of Patent: Oct. 10, 2017

(54) GENE EDITING IN THE OOCYTE BY CAS9 NUCLEASES

(71) Applicant: HELMHOLTZ ZENTRUM MÜNCHEN DEUTSCHES FORSCHUNGSZENTRUM FÜR GESUNDHEIT UND UMWELT, Neuherberg (DE)

(72) Inventors: Ralf Kühn, Freising (DE); Wolfgang Wurst, München (DE); Oskar Ortiz Sanchez, München (DE)

(73) Assignee: HELMHOLTZ ZENTRUM MÜNCHEN DEUTSCHES FORSCHUNGSZENTRUM FÜR GESUNDHEIT UND UMWELT, Neuherberg (DE)

( * ) Notice: Subject to any disclaimer, the term of this patent is extended or adjusted under 35 U.S.C. 154(b) by 0 days.

(21) Appl. No.: 14/836,231

(22) Filed: Aug. 26, 2015

(65) Prior Publication Data
US 2015/0376652 A1    Dec. 31, 2015

Related U.S. Application Data

(63) Continuation of application No. PCT/EP2014/053840, filed on Feb. 27, 2014.

(30) Foreign Application Priority Data

Feb. 27, 2013  (EP) .................................... 13157063

(51) Int. Cl.
| | | |
|---|---|---|
| *A01N 63/00* | (2006.01) | |
| *A61K 48/00* | (2006.01) | |
| *C12N 5/075* | (2010.01) | |
| *A01K 67/027* | (2006.01) | |
| *C12N 9/22* | (2006.01) | |
| *C12N 15/89* | (2006.01) | |
| *C12N 15/90* | (2006.01) | |
| *A61D 19/04* | (2006.01) | |
| *C12N 15/10* | (2006.01) | |

(52) U.S. Cl.
CPC ........ *C12N 5/0609* (2013.01); *A01K 67/0275* (2013.01); *A61D 19/04* (2013.01); *C12N 9/22* (2013.01); *C12N 15/102* (2013.01); *C12N 15/89* (2013.01); *C12N 15/907* (2013.01); *A01K 2217/072* (2013.01); *A01K 2217/075* (2013.01); *A01K 2227/105* (2013.01); *A01K 2267/03* (2013.01); *C12N 2800/80* (2013.01)

(58) Field of Classification Search
None
See application file for complete search history.

(56) References Cited

U.S. PATENT DOCUMENTS

| | | | |
|---|---|---|---|
| 8,110,720 B2 * | 2/2012 | Ferrara | ............. A01K 67/0275 536/23.1 |
| 8,586,526 B2 | 11/2013 | Gregory et al. | |
| 2012/0276537 A1 | 11/2012 | Kuhn et al. | |
| 2014/0068797 A1 | 3/2014 | Doudna et al. | |
| 2014/0273233 A1 | 9/2014 | Chen et al. | |
| 2016/0298135 A1 | 10/2016 | Chen et al. | |

FOREIGN PATENT DOCUMENTS

| | | | |
|---|---|---|---|
| WO | 2011051390 A1 | | 5/2011 |
| WO | 2011146121 A1 | | 11/2011 |
| WO | 2011154393 A1 | | 12/2011 |
| WO | 2013176772 A1 | † | 11/2013 |
| WO | 2013188522 | | 12/2013 |
| WO | 201401327 | | 3/2014 |
| WO | 2014089290 A1 | † | 6/2014 |

OTHER PUBLICATIONS

Meyer et al., "Modelign Disease Mutations by Gene Targeting in One-Cell Mouse Embryos", Proceedings of the Nation Academy of Sciences, vol. 109, No. 24, Jun. 12, 2012, pp. 9354-9359.
Wang et al., "One-Step Generation of Mice Carrying Mutations in Multiple Genes by CRISP/Cas-Meditated Genome Engineering", Cell vol. 153, No. 4, May 9, 2013, pp. 910-918.
LeCong et al., "Multiplex Genome Engineering Using CRISP/Cas-Systems", Science, vol. 339, No. 6121, Feb. 15, 2013, pp. 819-822.
Mali et al., "RNA-Guided Human Genome Engineering via Cas9", Science, vol. 339, No. 6121, Jan. 3, 2013, pp. 823-826.

(Continued)

*Primary Examiner* — Janice Li
(74) *Attorney, Agent, or Firm* — Roberts Mlotkowski Safran Cole & Calderon, P.C.

(57) ABSTRACT

The present invention relates to a method of producing a non-human, mammalian oocyte carrying a modified target sequence in its genome, the method comprising the steps of introducing into a non-human, mammalian oocyte: (a) a clustered, regularly interspaced, short palindromic repeats (CRISPR)-associated protein 9 (Cas9 protein) or a nucleic acid molecule encoding said Cas9 protein; and (b-i) a target sequence specific CRISPR RNA (crRNA) and a trans-activating crRNA (tracr RNA) or a nucleic acid molecule encoding said RNAs; or (b-ii) a chimaeric RNA sequence comprising a target sequence specific crRNA and tracrRNA or a nucleic acid molecule encoding said RNA; wherein the Cas9 protein introduced in (a) and the RNA sequence(s) introduced in (b-i) or (b-ii) form a protein/RNA complex that specifically binds to the target sequence and introduces a single or double strand break within the target sequence. The present invention further relates to the method of the invention, wherein the target sequence is modified by homologous recombination with a donor nucleic acid sequence further comprising the step: (c) introducing a nucleic acid molecule into the cell, wherein the nucleic acid molecule comprises the donor nucleic acid sequence and regions homologous to the target sequence. The present invention also relates to a method of producing a non-human mammal carrying a modified target sequence in its genome.

20 Claims, 4 Drawing Sheets

(56) References Cited

OTHER PUBLICATIONS

Hwang et al., "Efficient Genome Editing in Zebrafish Using a CRISP/Cas System", Nature Biotechnology, vol. 31, No. 3, Jan. 29, 2013, pp. 227-229.
Third Party Observations filed on Jun. 26, 2015 in a corresponding application PCT/EP2014/053840.
Bradley et al., Nature 1984; 309:255-6.
Capecchi, M. R., Nat Rev Genet 2005; 6: 507-12.
Altschul et al. (1990) J. Mol. Biol. 215, 403.
Amar et al., J. Clin. Microbiol. 40 (2002) 446-452.
Barrangou R, Horvath P (2012) Annu Rev Food Sci Technol 3:143-162.
Bebbington et al., Bio/Technology 1992, 10:169.
Bhaya et al. (2011) Annu Rev Genet 45:273-297.
Brinster RL, Braun RE, Lo D, Avarbock MR, Oram F, Palmiter RD.; Proc Natl Acad Sci U S A 1989; 86:7087-7091.
Carbery et al. (2010) Genetics 186:451-9.
Nagy A, Gertsenstein M, Vintersten K, Behringer R., 2003. Manipulating the Mouse Embryo. Cold Spring Harbour, New York: Cold Spring Harbour Laboratory Press.
Sambrook and Russel "Molecular Cloning, a Laboratory Manual", Cold Spring Harbor Laboratory, N.Y. (2001).
Adams et al. (Ed.), "Automated DNA Sequencing and Analysis", Academic Press, 1994.
Alphey, "DNA Sequencing: From Experimental Methods to Bioinformatics", Springer Verlag Publishing, 1997.
Meng et al., J. Clin. Endocrinol. Metab. 90 (2005) 3419-3422.
Altschul and Gish (1996) Methods Enzymol. 266, 460.
Schier, Human Antibodies Hybridomas, vol. 7, (1996), pp. 97-105.
Sung et al., "Knockout mice created by TALENmediatedgene targeting", (2013) Nat Biotechnol 31:23-24.
Tesson et al. "Knockout rats generated by embryo microinjection of TALENs" (2011). Nat Biotechnol 29:695-696.
Thomas et al., "Site-Directed Mutagenesis by Gene Targeting in Mouse Embryo-Derived Stem Cells", Cell (1987) 51:503-12.
Todd et al., "From the Chromosome to DNA: Restriction Fragment Length Polymorphism Analysis and Its Clinical Application", J. Oral Maxil. Surg. 59 (2001) 660-667.
Tost et al., "Genotyping single nucleotide polymorphisms by MALDI mass spectrometry in clinical applications", Clin. Biochem. 35 (2005) 335-350.
Van Langenhove et al., "The molecular basis of the frontotemporal lobar degeneration—amyotrophic lateral sclerosis spectrum", (2012) Ann Med 44:817-828.
Wasmeier et al., "Rab38 and Rab32 control post-Golgi traffi cking of melanogenic enzymes" (2006) J Cell Biol 175:271-281.
Youil et al., "Screening for mutations by enzyme mismatch cleavage with T4 endonuclease VII", Proc. Natl. Acad. Sci. U.S.A. 92 (1995) 87-91.
Mali et al., "RNA-Guided Human Genome Engineering Using CRISP/Cas-Systems", Science, vol. 339, No. 6121, Feb. 15, 2013, pp. 819-822.
Cermak et al., "Efficient design and assembly of custom TALEN and other TAL effector-based constructs for DNA targeting", (2011) Nucleic Acids Res 39:e82.
Christian et al., "Targeting DNA Double-Strand Breaks with TAL Effector Nucleases", (2010) Genetics 186:757-761.
Collins, "A Mouse for All Reasons", Rossant J, Wurst W., Cell (2007); 128:9-13.
Cui et al., "Tageting integration in rat and mouse embryos with zinc-finger nucleases", (2011) Nat Biotechnol 29:64-7.
Deltcheva et al., "CRISPR RNA maturation by trans-encoded small RNA and host factor RNase III", (2011) Nature 471:602-607.
Doyon et al., "Heritable targeted gene disruption in zebrafish using designed zinc-finger nucleases", (2008) Nat Biotechnol 26:702-8.
Evans et al., "Establishment in culture of pluripotential cells from mouse embryos", Nature (1981), 292:154-6.

Fiesel et al., "TDP-43 and FUS/TLS: cellular functions and implications for neurodegeneration", (2011) TDP FEBS J 278:3550-3568.
Flisikowska et al., "Efficient Immunoglobulin Gene Disruption and Targeted Replacement in Rabbit Using Zinc Finger Nucleases", (2011) PLoS One 6:e21045.
Geurts et al., "Knockout Rats Produced Using Designed Zinc Finger Nucleases", (2009) Science 325:433.
Gong et al., "Targeting multi-cellular organisms" (2003) Curr Opin Genet Dev 13:215-220.
Gossler et al., "Transgenesis by means of blastocyst-derived embryonic stem cell lines", Targ Proc Natl Acad Sci USA (1986) 83:9065-9.
Hsia et al., "Temperature gradient capillary electrophoresis (TGCE)—a tool for the high-throughput discovery and mapping of SNPs and IDPs", Theor. Appl. Genet. 111 (2005) 218-225.
Huang, "Heritable gene targeting in zebrafish using customized TALENs", (2011) Nat Biotechnol 29:699-700.
Jinek et al., "A Programmable Dual-RNA-Guided DNA Endonuclease in Adaptive Bacterial Immunity", (2012) Science 337:816-821.
Klug, "The Discovery of Zink Fingers and Their Applications in Gene Regulation and Genome Manipulation", (2010) Annu Rev Biochem 79:213-231.
Lai, "Creating genetically modified pigs by using nuclear transfer", Prather RS. Reprod Biol Endocrinol (2003) 1:82.
Loftus et al., "Mutation of melanosome protein RAB38 in chocolate mice", (2002) Proc Natl Acad Sci USA 99:4471-4476.
Lopes et al., "Melanosome Maturation Defect in Rab38-deficient Retinal Pigment Epithelium Results in Instability of Immature Melanosomes during Transient Melanogenesis", (2007) Mol Biol Cell 18:3914-3927.
Maeder et al. "Rapid "Open-Source" Engineering of Customized Zinc-Finger Nucleases for Highly Efficient Gene Modification", (2008) Mol Cell 31(2): 294-301.
Maeder et al., "Oligomerized Pool Engineering (OPEN): An "Open-Source" Protocol for Making Customized Zinc Finger Arrays" (2009) Nat Protoc 4(10): 1471-501.
Makarova et al., "Evolution and classification of the CRISPR-Cas system" (2011) Nat Rev Microbiol 9:467-477.
Makarova et al., Unification of Cas protein families and simple scenario for the origin and evolution of CRISPR-Cas systems, (2011) Biol Direct 6:38.
Martin, Isolation of a pluripotent cell line from early mouse embryos cultured in medium conditioned by teratocarcinoma stem cells:, Proc Natl Acad Sci U S A 1981; 78:7634-8.
Meyer et al. "Gene targeting by homologous recombination in mouse zygotes mediated by zinc-finger nucleases" (2010) Proc Natl Acad Sci U S A 107:15022-6.
Smith, "Identification of Common Molecular Subsequences" (1981) J. Mol. Biol., 147, 195.
Miller et al., "A TALE nuclease architecture for efficient genome editing", (2011) Nat Biotechnol 29:143-148.
Murphey et al., "Matrix metalloproteinase degradation of elastin, type IV collagen and proteoglycan", Biochem J. (1991), 227:277.
Nothias, "Regulation of Gene Expression at the Beginning of Mammalian Development", J Biol Chem 1995;270:22077-22080.
Nothias, "Uncoupling of transcription and translation during zygotic gene activation in the mouse", EMBO J (1996) 15:5715-5725.
Oiso et al., "The rat Ruby (R) locus is Rab38: identical mutations in Fawn-hooded and Tester-Moriyama rats derived from an ancestral Long Evans rat sub-strain", (2004) Mamm Genome 15:307-314.
Osanai et al., "Altered lung surfactant system in a Rab38-deficient rat model of Hermansky-Pudlak syndrome", (2010) Am J Physiol Lung Cell Mol Physiol 298:L243-251.
Owens et al., "Identification of two short internal ribosome entry sites selected from libraries of random oligonucleotides", Proc. Natl. Acad. Sci. USA 98 (2001), 1471-1476.
Palais et al., "Quantitative heteroduplex analysis for single nucleotide polymorphism genotyping" Anal. Biochem. 346 (2005) 167-175.

(56) References Cited

OTHER PUBLICATIONS

Palmiter et al., "Germ-Line Transformation of Mice", Annu Rev Genet (1986); 20:465-499.

Paques et al., "Multiple Pathways of Recombination Induced by Double-Strand Breaks in *Saccharomyces cerevisiae*", Microbiol Mol Biol Rev (1999); 63:349-404.

Paques et al., "Meganucleases and DNA Double-Strand Break-Induced Recombination: Perspectives for Gene Therapy", (2007) Curr Gene Ther 7(1): 49-66.

Pearson et al., "Improved Tools for Biological Sequence Comparison", (1988) Proc. Natl. Acad. Sci. USA 85, 2444.

Pieppo et al., "Birth of Correctly Genotyped Calves After Multiplex Marker Detection From Bovine Embryo Microblade Biopsies", Mol Reprod Dev (2007) 74:1373-1378.

Peterson et al., "Novel Mutations and SNPs Identified in CCR2 Using a New Comprehensive Denaturing Gradient Gel Electrophoresis Assay" Hum. Mutat. 20 (2002) 253-259.

Di Pietro et al., "The Cell Biology of Hermansky-Pudlak Syndrome: Recent Advances" (2005) Traffic 6:525-33.

Porteus et al, "Gene targeting using zinc finger nucleases", (2005) Nat Biotechnol 23:967-73.

Porteus et al, "Chimeric Nucleases Stimulate Gene Targeting in Human Cells", (2003) Science 300:763.

Ramon et al., "Pyrosequencing™: A one-step method for high resolution HLA typing" J. Transl. Med. 1 (2003) 9.

Reyon et al., "FLASH Assembly of TALENs Enables High-Throughput Genome Editing" (2012). Nat Biotechnol 30:460-465.

Rouet et al., "Introduction of Double-Strand Breaks into the Genome of Mouse Cells by Expression of a Rare-Cutting Endonuclease"; Mol Cell Biol 1994; 14: 8096-8106.

Rouet et al., "Expression of a site-specific endonuclease stimulates homologous recombination in mammalian cells", Proc Natl Acad Sci USA (1994); 91: 6064-6068.

Santiago et al., "Targeted gene knockout in mammalian cells by using engineered zinc-finger nucleases" (2008) Proc Natl Acad Sci U S A 105:5809-14.

Schwartzberg et al, "Germ-Line Transmission of a c-abl Mutation Produced by Targeted Gene Disruption in ES Cells" Science (1989); 246:799-803.

Third Party Submission filed on Apr. 27, 2017 in related U.S. Appl. No. 15/209,516.

\* cited by examiner
† cited by third party

GENE EDITING IN THE OOCYTE BY CAS9 NUCLEASES

RELATED APPLICATIONS

This application is a Continuation application filed under 35 USC §120 of International Application No. PCT/EP2014/053840, filed Feb. 27, 2014. This application claims priority under 35 USC §119 of EP Application 13157063.2 filed Feb. 27, 2013.

BACKGROUND

The present invention relates to a method of producing a non-human, mammalian oocyte carrying a modified target sequence in its genome, the method comprising the steps of introducing into a non-human, mammalian oocyte: (a) a clustered, regularly interspaced, short palindromic repeats (CRISPR)-associated protein 9 (Cas9 protein) or a nucleic acid molecule encoding said Cas9 protein; and (b-i) a target sequence specific CRISPR RNA (crRNA) and a trans-activating crRNA (tracr RNA) or a nucleic acid molecule encoding said RNAs; or (b-ii) a chimaeric RNA sequence comprising a target sequence specific crRNA and tracrRNA or a nucleic acid molecule encoding said RNA; wherein the Cas9 protein introduced in (a) and the RNA sequence(s) introduced in (b-i) or (b-ii) form a protein/RNA complex that specifically binds to the target sequence and introduces a single or double strand break within the target sequence. The present invention further relates to the method of the invention, wherein the target sequence is modified by homologous recombination with a donor nucleic acid sequence further comprising the step: (c) introducing a nucleic acid molecule into the cell, wherein the nucleic acid molecule comprises the donor nucleic acid sequence and regions homologous to the target sequence. The present invention also relates to a method of producing a non-human mammal carrying a modified target sequence in its genome.

In this specification, a number of documents including patent applications and manufacturer's manuals is cited. The disclosure of these documents, while not considered relevant for the patentability of this invention, is herewith incorporated by reference in its entirety. More specifically, all referenced documents are incorporated by reference to the same extent as if each individual document was specifically and individually indicated to be incorporated by reference.

Gene targeting in embryonic stem (ES) cells is routinely applied to modify the mammalian genome, in particular the mouse genome, which established the mouse as the most commonly used genetic animal model (Capecchi M R (2005)). The basis for reverse mouse genetics was initially established in the 1980-ies, when ES cell lines were established from cultured murine blastocysts, culture conditions were identified that maintain their pluripotent differentiation state in vitro (Evans M J, Kaufman M H., Nature 1981; 292:154-6; Martin G R. Proc Natl Acad Sci USA 1981; 78:7634-8) and it was found that ES cells are able to colonize the germ line in chimaeric mice upon microinjection into blastocysts (Bradley et al., Nature 1984; 309:255-6; Gossler et al., Proc Natl Acad Sci USA 1986; 83:9065-9). Since the first demonstration of homologous recombination in ES cells in 1987 (Thomas K R, Capecchi M R., Cell 1987; 51:503-12) and the establishment of the first knockout mouse strain in 1989 (Schwartzberg P L, Goff S P, Robertson E J., Science 1989; 246:799-803) gene targeting was adopted to a plurality of genes and has been used in the last decades to generate more than 3000 knockout mouse strains that provided a wealth of information on in vivo gene functions (Collins F S, Rossant J, Wurst W., Cell 2007; 128:9-13; Capecchi, M. R., Nat Rev Genet 2005; 6: 507-12). Accordingly, gene targeting in ES cells has revolutionised the in vivo analysis of mammalian gene function using the mouse as genetic model system. However, at present this reverse genetics approach is restricted to mice, as germ line competent ES cell lines that can be genetically modified could be established only from these animals, so far. The exception from this rule is achieved by homologous recombination in primary cells from pig and sheep followed by the transplantation of nuclei from recombined somatic cells into enucleated oocytes (cloning) (Lai L, Prather R S. 2003. Reprod Biol Endocrinol 2003; 1:82; Gong M, Rong Y S. 2003. Curr Opin Genet Dev 13:215-220). However, since this methodology is inefficient and time consuming it did not develop into a simple routine procedure.

Although the generation of targeted mouse mutants as described above is by now well established as a routine procedure, this approach has the drawback that is usually requires a long time of hands on work for vector construction, ES cell culture and selection and the breeding of chimaeras. Additional problems that are often encountered during a gene targeting project are the low efficiency of homologous recombination in ES cells and the loss of the germ line competence of ES cells during the long in vitro culture and selection phase. Therefore, the successful generation of even a single line of knockout mice requires considerable time, the combined efforts of specialists in molecular biology, ES cell culture and embryo manipulation, and the associated technical infrastructure.

Experiments in model systems have demonstrated that the frequency of homologous recombination of a gene targeting vector is strongly increased if a double strand break is induced within its chromosomal target sequence (Rouet, P., Smih, F., Jasin, M.; Mol Cell Biol 1994; 14: 8096-8106; Rouet, P., Smih, F. Jasin, M.; Proc Natl Acad Sci USA 1994; 91: 6064-6068). In the absence of a gene targeting vector for homology directed repair, the cells frequently close the break by non-homologous end-joining (NHEJ). Since this mechanism is error-prone it frequently leads to the deletion or insertion of multiple nucleotides at the cleavage site. If the cleavage site is located within the coding region of a gene it is thereby possible to identify and select mutants that exhibit reading frameshift mutations from a mutagenised population and that represent non-functional knockout alleles of the targeted gene.

Direct genome editing by zinc-finger nucleases (ZFN) as well as TAL-nucleases in one-cell embryos has been recently established as a double strand break-based mutagenesis approach in mice, rats, rabbits and zebrafish (Carbery et al. (2010) *Genetics* 186:451-9; Cui et al. (2011) *Nat Biotechnol* 29:64-7; Doyon et al. (2008) *Nat Biotechnol* 26:702-8; Flisikowska et al. (2011) *PLoS One* 6:e21045; Meyer et al. (2010) *Proc Natl Acad Sci USA* 107:15022-6; Geurts A M, et al. (2009) *Science* 325:433; Huang (2011) *Nat Biotechnol* 29:699-700; Tesson (2011) *Nat Biotechnol* 29:695-696). Such nucleases are designed to induce double-strand breaks (DSBs) at preselected genomic target sites (Klug (2010) *Annu Rev Biochem* 79:213-231; Porteus & Carroll (2005) *Nat Biotechnol* 23:967-73; Porteus & Baltimore (2003) *Science* 300:763; Santiago et al. (2008) *Proc Natl Acad Sci USA* 105:5809-14). DSBs targeted to coding exons frequently undergo sequence deletions leading to gene knockout or allow the insertion (knock-in) of DNA sequences from gene targeting vectors via homologous recombination (HR). The generation of knockout and knock-in mutants at the Rosa26, Mdr1a, Pxr, and IgM loci by microinjection of ZFNs one-cell embryos of mice, rats and rabbits (Cui et al. (2011) *Nat Biotechnol* 29:64-7; Flisikowska et al. (2011) *PLoS One* 6:e21045; Meyer et al. (2010) *Proc Natl Acad Sci USA* 107:15022-6; Huang (2011) *Nat Biotechnol* 29:699-700; Tesson (2011) *Nat Biotechnol* 29:695-696) has recently been reported.

In addition, TAL elements have been combined with the FokI nuclease domain to create TAL-nuclease fusion proteins (TALENs) that enable to generate double-strand breaks within intended target regions (Christian M et al. (2010). *Genetics* 186:757-761; Cermak et al. (2011) *Nucleic Acids Res* 39:e82; Miller et al. (2011) *Nat Biotechnol* 29:143-148). TALENs were shown to enable gene editing in mammalian cell lines and in zebrafish, mouse and rat embryos (Sung et al. (2013) *Nat Biotechnol* 31:23-24; Tesson et al. (2011). *Nat Biotechnol* 29:695-696; Reyon et al. (2012). *Nat Biotechnol* 30:460-465).

However, even though the use of zinc finger nucleases results in a higher frequency of homologous recombination, considerable efforts and time are required to design zinc finger proteins that bind a new DNA target sequence at high efficiency. In addition, it has been calculated that using the presently available resources only one zinc finger nuclease could be found within a target region of 1000 basepairs of the mammalian genome (Maeder, et al. 2008 Mol Cell 31(2): 294-301; Maeder, et al. 2009 Nat Protoc 4(10): 1471-501). Further, the use of TALENs involves considerable efforts since it requires the de novo construction and expression of two large TAL-nuclease fusion proteins specifically for each target site. Also, the principles of the TAL peptide DNA recognition are still not fully understood, thus often leading to the necessity of time- and cost-consuming further experimentations in order to optimize the respective TALENs.

Recently, a novel system for inducing single or double strand breaks in target nucleic acid sequences has been found. This system is referred to in the art as CRISPR/Cas system, which stands for "clustered, regularly interspaced, short palindromic repeats (CRISPR)/CRISPR-associated protein". It is based on an adaptive defense mechanism evolved by bacteria and archaea to protect them from invading viruses and plasmids, which relies on small RNAs for sequence-specific detection and silencing of foreign nucleic acids. CRISPR/Cas systems are composed of cas genes organized in operon(s) and CRISPR array(s) consisting of genome-targeting sequences (called spacers) interspersed with identical repeats (Bhaya et al. (2011) *Annu Rev Genet* 45:273-297; Barrangou R, Horvath P (2012) *Annu Rev Food Sci Technol* 3:143-162). CRISPR/Cas-mediated immunity in bacteria and archaea occurs in three steps. In the adaptive phase, bacteria and archaea harboring one or more CRISPR loci respond to viral or plasmid challenge by integrating short fragments of foreign sequence (protospacers) into the host chromosome at the proximal end of the CRISPR array. In the expression and interference phases, transcription of the repeat spacer element into precursor CRISPR RNA (pre-crRNA) molecules followed by enzymatic cleavage yields short crRNAs (CRISPR RNAs) that can subsequently pair with complementary protospacer sequences of invading viral or plasmid targets. Target recognition by crRNAs directs the silencing of the foreign sequences by means of Cas proteins that function in complex with the crRNAs.

There are three types of CRISPR/Cas systems (Makarova et al. (2011) *Nat Rev Microbiol* 9:467-477). The type I and III systems share some overarching features: specialized Cas endonucleases process the pre-crRNAs, and once mature, each crRNA assembles into a large multi-Cas protein complex capable of recognizing and cleaving nucleic acids complementary to the crRNA.

In contrast, type II systems process precrRNAs by a different mechanism in which a trans-activating crRNA (tracrRNA) complementary to the repeat sequences in pre-crRNA triggers processing by the double-stranded RNA specific ribonuclease RNase III in the presence of Cas9 (formerly Csn1) protein. Cas9 is the sole protein responsible for crRNA-guided silencing of foreign DNA.

Jinek et al. recently demonstrated that the Cas9 endonuclease family can also be programmed with single "chimaeric" RNA molecules, containing a target recognition sequence at the 5' end followed by a hairpin structure retaining the base-pairing interactions that occur between the tracrRNA and the crRNA (Jinek et al. (2012 *Science* 337:816-821). This single transcript effectively fuses the 3' end of crRNA to the 5' end of tracrRNA, thereby mimicking the dual-RNA structure required to guide site-specific DNA cleavage by Cas9.

The *Streptococcus pyogenes* SF370 type II CRISPR locus consists of four genes, including the Cas9 nuclease, as well as two non-coding RNAs: tracrRNA and a pre-crRNA array containing nuclease guide sequences (spacers) interspaced by identical direct repeats (DRs) (Deltcheva et al. (2011) *Nature* 471:602-607).

Cong et al. (Cong et al. (2013). *Science* 339:819-823) recently applied this prokaryotic RNA-programmable nuclease system to introduce targeted double stranded breaks (DSBs) in mammalian chromosomes through heterologous expression of the key components. It has been previously shown (Jinek et al. (2012 *Science* 337:816-821) that expression of tracrRNA, pre-crRNA, host factor RNase III, and Cas9 nuclease are necessary and sufficient for cleavage of DNA in vitro. Expression of a codon optimized *S. pyogenes* Cas9 (SpCas9), of an 89-nucleotide (nt) tracrRNA and of a pre-crRNA comprising a single guide spacer flanked by DRs was expressed in human 293 cells. The initial spacer was designed to target a 30-basepair (bp) site (protospacer) in the human EMX1 locus that precedes an NGG, the requisite protospacer adjacent motif (PAM). Heterologous expression of the CRISPR system (SpCas9, SpRNase III, tracrRNA, and pre-crRNA) achieved targeted cleavage of mammalian chromosomes. In addition, a chimeric crRNA-tracrRNA hybrid was used, where a mature crRNA is fused to a partial tracrRNA via a synthetic stem-loop to mimic the natural crRNA:tracrRNA duplex. Cong et al. observed cleavage of all protospacer targets when SpCas9 was co-expressed with pre-crRNA (DRspacer-DR) and tracrRNA. Furthermore, Cong et al. showed that also the *Streptococcus thermophilus* LMD-9 CRISPR1 system can mediate mammalian genome cleavage.

In another recent report, Mali et al. (Mali et al. (2013); Science 339: 823-826) independently confirmed high efficiency CRISPR-mediated genome targeting in several human cell lines, while Hwang et al. (Hwang et al. (2013); Nature Biotechnology doi:10.1038/nbt.2501) showed that this system may also be employed in zebrafish.

Whereas this system has been shown to be functional in mammalian cells such as human embryonal kidney cells (such as e.g. 293T or 293 FT cells), human chronic myeloid leukemia cells (such as K562 cells) or induced pluripotent stem cells, no attempts have been reported to employ this system in oocytes/zygotes.

As totipotent single entities, mammalian zygotes could be regarded as a preferred substrate for genome engineering since the germ line of the entire animal is accessible within a single cell. However, the experimental accessibility and manipulation of zygotes is severely restricted by the very limited numbers at which they are available (dozens-hundred) and their very short lasting nature. These parameters readily explain that the vast majority of genome manipulations, that occur at frequencies of below $10^{-5}$ like gene targeting, can be successfully performed only in cultured embryonic stem cells that are grown up to a number of $10^7$ cells in a single standard culture plate. The only exception from this rule concerns the generation of transgenic mice by pronuclear DNA injection that has been developed into a routine procedure due to the high frequency of transgene integration in up to 30% of injected zygotes (Palmiter R D, Brinster R L.; Annu Rev Genet 1986; 20:465-499). Since microinjected transgenes randomly integrate into the genome, this method can only be used to express additional genes on the background of an otherwise normal genome, but does not allow the targeted modification of endogenous genes.

An early report to characterize the potential of zygotes for targeted gene manipulation by Brinster (Brinster R L, Braun R E, Lo D, Avarbock M R, Oram F, Palmiter R D.; Proc Natl Acad Sci USA 1989; 86:7087-7091) showed that this approach is not practical as only one targeted mouse was obtained from >10.000 zygotes within 14 months of injections. Thus, Brinster et al. discouraged any further attempts in this direction. In addition to a low recombination frequency, Brinster et al. noted a high number of spontaneously occurring, undesired mutations within the targeted allele that severely compromised the function of the (repaired) histocompatibility class II gene. From the experience of Brinster et al. it could be extrapolated that the physiological, biochemical and epigenetic context of genomic DNA in the zygotic pronuclei are unfavourable to achieve targeted genetic manipulations, except for the random integration of transgenes that occurs at high frequency.

In addition, the biology of oocyte development into an embryo provides further obstacles for targeted genetic manipulations.

A growing mouse oocyte, arrested at diplotene of its first meiotic prophase, transcribes and translates many of its own genes, thereby producing a store of proteins sufficient to support development up to the 8-cell stage. These transcripts guide oocytes on the two steps of oocyte maturation and egg activation to become zygotes. Typically, oocytes are ovulated and become competent for fertilisation before reaching a second arrest point. When an oocyte matures into an egg, it arrests in metaphase of its second meiotic division where transcription stops and translation of mRNA is reduced. At this point an ovulated mouse egg has a diameter of 0.085 mm and, with a volume of ~300 picoliter, it exceeds the size of a typical somatic cell by a 1000-fold (Nagy A, Gertsenstein M, Vintersten K, Behringer R., 2003. Manipulating the Mouse Embryo. Cold Spring Harbour, N.Y.: Cold Spring Harbour Laboratory Press). The re-modeling of a fertilised oocyte into a totipotent zygote is one of the most complex cell transformations in biology. Remarkably, and in stark contrast to other mammalian cell types, this transition occurs in the absence of transcription factors and therefore depends on proteins and mRNAs accumulated in the oocyte during oogenesis. The embryonic development of a mammal begins when sperm fertilises an egg to form a zygote. Fertilization of the egg triggers egg activation to complete the transformation to a zygote by signaling the completion of meiosis and the formation of pronuclei. At this stage the zygote represents a 1-cell embryo that contains a haploid paternal pronucleus derived from the sperm and a haploid maternal pronucleus derived from the oocyte. In mice this totipotent single cell stage lasts for only ~18 hours until the first mitotic division occurs.

In fertilized mammalian eggs, the two pronuclei that undergo DNA replication, do not fuse directly but approach each other and remain distinct until the membrane of each pronucleus has broken down in preparation for the zygote's first mitotic division that produces a 2-cell embryo. The 1-cell zygote stage is characterised by unique transcriptional and translation control mechanisms. One of the most striking features is a time-dependent mechanism, referred to as the zygotic clock, that delays the expression of the zygotic genome for ~24 h after fertilization, regardless of whether or not the one-cell embryo has completed S phase and formed a two-cell embryo (Nothias J Y, Majumder S, Kaneko K J, DePamphilis M L.; J Biol Chem 1995; 270:22077-22080). In nature, the zygotic clock provides the advantage of delaying zygotic gene activation (ZGA) until chromatin can be remodelled from a condensed meiotic state to one in which selected genes can be transcribed. Since the paternal genome is completely packaged with protamines that must be replaced with histones, some genes would be prematurely expressed if ZGA were not prevented. Cell-specific transcription requires that newly minted zygotic chromosomes repress most, if not all, promoters until development progresses to a stage where specific promoters can be activated by specific enhancers or trans-activators. In the mouse, formation of a 2-cell embryo marks the transition from maternal gene dependence to zygotic gene activation (ZGA). Among mammals, the extent of development prior to zygotic gene activation (ZGA) varies among species from one to four cleavage events. Maternal mRNA degradation is triggered by meiotic maturation and 90% completed in 2-cell embryos, although maternal protein synthesis continues into the 8-cell stage. In addition to transcriptional control, the zygotic clock delays the translation of nascent mRNA until the 2-cell stage (Nothias J Y, Miranda M, DePamphilis M L.; EMBO J 1996; 15:5715-5725). Therefore, the production of proteins from transgenic expression vectors injected into pronuclei is not achieved until 10-12 hours after the appearance of mRNA.

WO2011/051390 describes a method for modifying a target sequence in the genome of a mammalian or avian oocyte by homlogous recombination using a zinc finger nuclease and, thus, a method of producing a non-human mammal carrying a modified target sequence in its genome. However, since this method makes use of a zinc finger protein, it is associated with the drawbacks described above with regard to zinc finger proteins. No indication is provided in WO2011/051390 that successful recombination in oocytes could be achieved by any other means but zinc finger proteins.

WO2011/154393 describes a method of modifying a target sequence in the genome of a eukaryotic cell, wherein a fusion protein comprising a DNA-binding domain of a TaI effector protein and a non-specific cleavage domain of a restriction nuclease is employed to introduce a double strand break within the target sequence, thereby enhancing the modification of the target sequence by homologous recombination. It is further described that the method can be applied to oocytes and that it can be used to produce a non-human mammal or vertebrate carrying a modified target sequence in its genome. However, the only methods for introducing double strand breaks and enhancing the frequency of homologous recombination that are described in WO2011/154393 are the use of zinc finger proteins or fusion proteins comprising a DNA-binding domain of a TaI effector protein and a non-specific cleavage domain of a restriction nuclease. No reference is made to the CRISPR/Cas system and no indication is provided that the frequency of homologous recombination in oocytes could be enhanced by any means other than Zinc finger proteins or the claimed fusion proteins.

Thus, whereas methods have been described in the art for the generation of transgenic animals carrying targeted modifications in their genome, there is still a need to provide means to generate genetically modified animals faster, easier and more cost-effective than using any of the prior art methods.

This need is addressed by providing the embodiments characterized in the claims.

Discosure

Accordingly, the present invention relates to a method of producing a non-human, mammalian oocyte carrying a modified target sequence in its genome, the method comprising the steps of introducing into a non-human, mammalian oocyte: (a) a clustered, regularly interspaced, short palindromic repeats (CRISPR)-associated protein 9 (Cas9 protein) or a nucleic acid molecule encoding said Cas9 protein; and (b-i) a target sequence specific CRISPR RNA (crRNA) and a trans-activating crRNA (tracr RNA) or a nucleic acid molecule encoding said RNAs; or (b-ii) a chimaeric RNA sequence comprising a target sequence specific crRNA and tracrRNA or a nucleic acid molecule encoding said RNA; wherein the Cas9 protein introduced in (a) and the RNA sequence(s) introduced in (b-i) or (b-ii) form a protein/RNA complex that specifically binds to the target sequence and introduces a single or double strand break within the target sequence.

The term "oocyte", as used herein, refers to the female germ cell involved in reproduction, i.e. the ovum or egg cell. In accordance with the present invention, the term "oocyte" comprises both oocytes before fertilisation as well as fertilised oocytes, which are also called zygotes. Thus, the oocyte before fertilisation comprises only maternal chromosomes, whereas an oocyte after fertilisation comprises both maternal and paternal chromosomes. After fertilisation, the oocyte remains in a double-haploid status for several hours, in mice for example for up to 18 hours after fertilisation.

In a more preferred embodiment of the method of the invention, the oocyte is a fertilised oocyte.

The term "fertilised oocyte", as used herein, refers to an oocyte after fusion with the fertilizing sperm. For a period of many hours (such as up to 18 hours in mice) after fertilisation, the oocyte is in a double-haploid state, comprising one maternal haploid pronucleus and one paternal haploid pronucleus. After migration of the two pronuclei together, their membranes break down, and the two genomes condense into chromosomes, thereby reconstituting a diploid organism. This fertilised oocyte, also referred to as a one-cell zygote and also the 2-cell and 4-cell stage zygote, are also encompassed by the term "fertilised oocyte", as used herein.

Preferably, the mammalian oocyte used in the method of the present invention is a fertilised mammalian oocyte in the double-haploid state.

In accordance with the present invention, a "modified target sequence" is a nucleotide sequence in which genomic manipulations have led to an alteration of the respective target nucleotide sequence. The term "target sequence in the genome", as used herein, refers to the genomic location that is to be modified by the method of the invention. The "target sequence in the genome" comprises but is not restricted to the nucleotide(s) subject to the particular modification, i.e. the "target sequence in the genome" also comprises the sequence surrounding the relevant nucleotide(s) to be modified. Preferably the "target sequence in the genome" also comprises at least 10, such as at least 100, such as at least 200, such as at least 500, such as at least 1000 nucleotide(s) upstream and/or downstream of the relevant nucleotide(s) to be modified.

More preferably, the term "target sequence" refers to the entire gene to be modified.

The term "modified" includes, but is not limited to, one or more nucleotides that are substituted, inserted and deleted within the target sequence.

The term "substitution", as used herein, is defined in accordance with the pertinent art and refers to the replacement of nucleotides with other nucleotides. The term includes for example the replacement of single nucleotides resulting in point mutations. Said point mutations can lead to an amino acid exchange in the resulting protein product but may also not be reflected on the amino acid level (i.e. silent mutations). Also encompassed by the term "substitution" are mutations resulting in the replacement of multiple nucleotides, such as for example parts of genes, such as parts of exons or introns as well as the replacement of entire genes. The number of nucleotides that replace the originally present nucleotides may be the same or different (i.e. more or less) as compared to the number of nucleotides removed. Preferably, the number of replacement nucleotides corresponds to the number of originally present nucleotides that are substituted.

The term "insertion", in accordance with the present invention, is defined in accordance with the pertinent art and refers to the incorporation of one or more nucleotides into a nucleic acid molecule. Insertion of parts of genes, such as parts of exons or introns as well as insertion of entire genes is also encompassed by the term "insertion". When the number of inserted nucleotides is not dividable by three, the insertion can result in a frameshift mutation within a coding sequence of a gene. Such frameshift mutations will alter the amino acids encoded by a gene following the mutation. In some cases, such a mutation will cause the active translation of the gene to encounter a premature stop codon, resulting in an end to translation and the production of a truncated protein. When the number of inserted nucleotides is instead dividable by three, the resulting insertion is an "in-frame insertion". In this case, the reading frame remains intact after the insertion and translation will most likely run to completion if the inserted nucleotides do not code for a stop codon. However, because of the inserted nucleotides, the finished protein will contain, depending on the size of the insertion, one or multiple new amino acids that may affect the function of the protein.

The term "deletion", as used in accordance with the present invention, is defined in accordance with the pertinent art and refers to the loss of nucleotides or larger parts of genes, such as exons or introns as well as entire genes. As defined with regard to the term "insertion", the deletion of a number of nucleotides that is not evenly dividable by three will lead to a frameshift mutation, causing all of the codons occurring after the deletion to be read incorrectly during translation, potentially producing a severely altered and most likely non-functional protein. If a deletion does not result in a frameshift mutation, i.e. because the number of nucleotides deleted is dividable by three, the resulting protein is nonetheless altered as the finished protein will lack, depending on the size of the deletion, one or several amino acids that may affect the function of the protein.

The above defined modifications are not restricted to coding regions in the genome, but can also be introduced into non-coding regions of the target genome, for example in regulatory regions such as promoter or enhancer elements or in introns.

Examples of modifications of the target genome include both targeted and random modifications, such as e.g. the introduction of mutations into a wildtype gene in order to analyse its effect on gene function; the replacement of an entire gene with a mutated gene or, alternatively, if the target sequence comprises mutation(s), the alteration of these mutations to identify which one is causative of a particular effect; the removal of entire genes or proteins or the removal of regulatory elements from genes or proteins as well as the introduction of fusion-partners, such as for example purification tags such as the his-tag or the tap-tag.

In a first step, step (a), a clustered, regularly interspaced, short palindromic repeats (CRISPR)-associated protein 9 (Cas9 protein or nucleic acid molecule encoding said Cas9) is introduced into a non-human, mammalian oocyte.

The term "introducing into the oocyte", as used herein, relates to any known method of bringing a protein or a nucleic acid molecule into an oocyte. Non-limiting examples include microinjection, infection with viral vectors, electroporation and the formulation with cationic lipids. All these methods are well known in the art.

The term "Cas9 protein" refers to the "clustered, regularly interspaced, short palindromic repeats (CRISPR)-associated protein 9". This term is well known in the art and has been described, e.g. in Makarova et al. (2011). *Nat Rev Microbiol* 9:467-477 and in Makarova et al. (2011) *Biol Direct* 6:38.

Cas proteins are endonuclease that form part of an adaptive defense mechanism evolved by bacteria and archaea to protect them from invading viruses and plasmids, as discussed herein above. Cas9 proteins constitute a family of enzymes that require a base-paired structure formed between an activating tracrRNA and a targeting crRNA to cleave target dsDNA. Site-specific cleavage occurs at locations determined by both base-pairing complementarity between the crRNA and the target protospacer DNA and a short motif, referred to as the protospacer adjacent motif (PAM), juxtaposed to the complementary region in the target DNA (Jinek et al. (2012 *Science* 337:816-821)). The tracrRNA: crRNA-guided Cas9 protein makes use of distinct endonuclease domains (HNH and RuvC-like domains) to cleave the two strands in the target DNA. Target recognition by e.g. *Streptococcus pyogenes* SF370 type II Cas9 requires both a seed sequence in the crRNA and a GG dinucleotide-containing PAM sequence adjacent to the crRNA-binding region in the DNA target (Jinek et al. (2012 *Science* 337: 816-821).

Any Cas9 protein known in the art may be employed in accordance with the present invention. So far, at least 65 different Cas9 proteins related to the *Streptococcus pyogenes* SF370 type II Cas9 protein have been described. These proteins, previously named Csn1, were reclassified into a family of Cas9 proteins (Makarova et al. (2011). *Nat Rev Microbiol* 9:467-477; Makarova et al. (2011) *Biol Direct* 6:38). The Cas9 family includes, without being limiting, the following family members referred to by their gene numbers according to the eggNOG (evolutionary genealogy of genes: Non-supervised Orthologous Groups) database (see the world wide web at eggnog.embl.de/version_3.0/): gene No. Acel_1951 (HNH endonuclease) (SEQ ID NO:17) of *Acidothermus cellulolyticus*, gene No. Amuc_2010 (hypothetical protein) (SEQ ID NO:18) of *Akkermansia muciniphila*, gene No. Asuc_0376 (CRISPR-associated endonuclease Csn1 family protein) (SEQ ID NO:19) of *Actinobacillus succinogenes*, gene No. BBta_3952 (hypothetical protein) (SEQ ID NO:20) of *Bradyrhizobium* sp. BTAi1, gene No. BF3954 (hypothetical protein) (SEQ ID NO:21) of *Bacteroides fragilis* 9343, gene No. Ccel_3120 (CRISPR-associated protein, Csn1 family) (SEQ ID NO:22) of *Clostridium cellulolyticum*, gene No. Cj1523c (putative CRISPR-associated protein) (SEQ ID NO:23) of *Campylobacter jejuni* 11168, gene No. Coch_0568 (CRISPR-associated protein, Csn1 family) (SEQ ID NO:24) of *Capnocytophaga ochracea*, gene No. DIP0036 (hypothetical protein) (SEQ ID NO:25) of *Corynebacterium diphtheriae*, gene No. Dshi_0400 (CRISPR-associated protein) (SEQ ID NO:26) *Dinoroseobacter shibae*, gene No. Dtpsy_0060 (CRISPR-associated protein, Csn1 family) (SEQ ID NO:27) of *Diaphorobacter* sp. TPSY, gene No. Emin_0243 (CRISPR-associated endonuclease Csn1 family protein) (SEQ ID NO:28) of *Elusimicrobium minutum*, gene No. EUBREC_1713 (CRISPR-system related protein) (SEQ ID NO:29) of *Eubacterium rectal*, gene No. Fisuc_0140 (CRISPR-associated protein, Csn1 family) (SEQ ID No:30) of *Fibrobacter succinogenes*, gene No. FMG_0058 (hypothetical protein) (SEQ ID N0:31) of *Finegoldia magna*, gene No. FP1524 (CRISPR-associated endonuclease Csn1 family protein) (SEQ ID N0:32) of *Flavobacterium psychrophilum*, gene No. gbs0911 (hypothetical protein) (SEQ ID N0:33) of *Streptococcus agalactiae* NEM316, gene No. GDI2123 (hypothetical protein) (SEQ ID NO:34) of *Gluconacetobacter diazotrophicus*, gene No. HH_1476 (hypothetical protein) (SEQ ID NO:35) of *Helicobacter hepaticus*, gene No. LCABL_23780 (hypothetical protein) (SEQ ID N0:36) of *Lactobacillus casei* BL23, gene No. lin2744 (hypothetical protein) (SEQ ID N0:37) of *Listeria innocua*, gene No. LSL_0095 (hypothetical protein) (SEQ ID N0:38) of *Lactobacillus salivarius*, gene No. M28_Spy0748 (putative cytoplasmic protein) (SEQ ID N0:39) of *Streptococcus pyogenes* MGAS6180, gene No. MGAS10270_Spy0886 (putative cytoplasmic protein) (SEQ ID N0:40) of *Streptococcus pyogenes* MGAS10270, gene No. MGAS10750_Spy0921 (hypothetical cytosolic protein) (SEQ ID NO:41) of *Streptococcus pyogenes* MGAS10750, gene No. MGAS2096_Spy0843 (putative cytoplasmic protein) (SEQ ID NO:42) of *Streptococcus pyogenes* MGAS2096, gene No. MGAS9429_Spy0885 (putative cytoplasmic protein) (SEQ ID NO:43) of *Streptococcus pyogenes* MGAS9429, gene No. MMOB0330 (hypothetical protein) (SEQ ID NO:44) of *Mycoplasma mobile*, gene No. MS53_0582 (hypothetical protein) (SEQ ID NO:45) of *Mycoplasma synoviae*, gene No. Nham_2832 (hypothetical protein) (SEQ ID NO:46) of *Nitrobacter hamburgensis*, gene No. Nham_4054 (hypothetical protein) (SEQ ID NO:47) of *Nitrobacter hamburgensis*, gene No. NMA0631 (hypothetical protein) (SEQ ID NO:48) of *Neisseria meningitidis* Z2491, gene No. NMO_0348 (putative CRISPR-associated protein) (SEQ ID NO:49) of *Neisseria meningitidis* alpha14, gene No. Plav_0099 (CRISPR-associated endonuclease Csn1 family protein) (SEQ ID NO:50) of *Parvibaculum lavamentivorans*, gene No. PM1127 (hypothetical protein) (SEQ ID NO:51) of *Pasteurella multocida*, gene No. RPC_4489 (hypothetical protein) (SEQ ID NO:52) of *Rhodopseudomonas palustris* BisB18, gene No. RPD_1029 (CRISPR-associated Cas5e family protein) (SEQ ID NO:53) of *Rhodopseudomonas palustris* BisB5, gene No. Rru_A0453 (CRISPR-associated endonuclease Csn1 family protein) (SEQ ID NO:54) of *Rhodospirillum rubrum*, gene No. SAG0894 (hypothetical protein) (SEQ ID NO:55) of *Streptococcus agalactiae* 2603V/R, gene No.

SAK_1017 (hypothetical protein) (SEQ ID NO:56) of *Streptococcus agalactiae* A909, gene No. Smon_1063 (CRISPR-associated protein, Csn1 family) (SEQ ID NO:57) of *Streptobacillus moniliformis*, gene No. SMU_1405c (hypothetical protein) (SEQ ID NO:58) of *Streptococcus mutans*, gene No. SPs1176 (hypothetical protein) (SEQ ID NO:59) of *Streptococcus pyogenes* SSI1, gene No. Spy49_0823 (hypothetical protein) (SEQ ID NO:60) of *Streptococcus pyogenes* NZ131, gene No. SPy_1046 (hypothetical protein) (SEQ ID NO:61) of *Streptococcus pyogenes* M1 GAS, gene No. SPy_1046 (putative cytoplasmic protein) (SEQ ID NO:62) of *Streptococcus pyogenes* MGAS5005, gene No. STER_0709 (CRISPR-system-like protein) (SEQ ID NO:63) of *Streptococcus thermophilus* LMD9, gene No. STER_1477 (CRISPR-system-like protein) (SEQ ID NO:64) of *Streptococcus thermophilus* LMD9, gene No. str0657 (hypothetical protein) (SEQ ID NO:65) of *Streptococcus thermophilus* Z1066, gene No. stu0657 (hypothetical protein) (SEQ ID NO:66) of *Streptococcus thermophilus* 18311, gene No. TDE_0327 (CRISPR-associated Cas5e family protein) (SEQ ID NO:67) of *Treponema denticola*, gene No. TGRD_056 (Csn1-like CRISPR-associated protein) (SEQ ID NO:68) of Uncultered bacterium TG1RsD17, gene No. TGRD_222 (CRISPR-associated protein Csn1) (SEQ ID NO:69) of Uncultered bacterium TG1RsD17, gene No. Veis_1230 (CRISPR-associated endonuclease Csn1 family protein) (SEQ ID NO:70) of *Verminephrobacter eiseniae*, gene No. WS1445 (hypothetical protein) (SEQ ID NO:71) of *Wolinella succinogenes*, and the microbial proteins of SEQ ID NO:72 to 81.

The *Streptococcus pyogenes* SF370 type II Cas9 has been described in e.g. Jinek et al. (2012 Science 337:816-821) and has an amino acid sequence as shown in SEQ ID NO:14. A version of this Cas9 protein optimised for use in mammalian cells has been employed in the appended examples and is shown in SEQ ID NO:2.

The Cas9 protein may also be a modified Cas9 protein, wherein the nuclease function of the protein is altered into a nicking endonuclease function. In other words, the naturally occurring Cas9 endonucleases function of cleaving both strands of a double-stranded target DNA, is altered into an endonuclease that cleaves (i.e. nicks) only one of the strands. Means and methods of modifying a Cas9 protein accordingly are well known in the art, and include for example the introduction of amino acid replacements into Cas9 that render one of the nuclease domains inactive. More specifically, aspartate can for example be replaced against alanine at position 10 of the *Streptococcus pyogenes* Cas9 (see for example the Cas9 D10A variant shown in SEQ ID No: 15), as shown by Cong et al. (2013) Science 339:819-823.

The use of a modified Cas9 protein having nicking endonuclease function provides the advantage that the thus introduced DNA damage in the genome is more likely to be repaired via homologous recombination, instead of by non-homologous end joining.

In accordance with the method of the invention, the Cas9 protein may be introduced as a protein, but alternatively the Cas9 protein may also be introduced in form of a nucleic acid molecule encoding said protein. It will be appreciated that the nucleic acid molecule encodes said Cas9 protein in expressible form such that expression in the oocyte results in a functional Cas9 protein. Means and methods to ensure expression of a functional polypeptide are well known in the art. For example, the coding sequences may be comprised in a vector, such as for example a plasmid, cosmid, virus, bacteriophage or another vector used conventionally e.g. in genetic engineering. The coding sequences inserted in the vector can e.g. be synthesized by standard methods, or isolated from natural sources. The coding sequences may further be ligated to transcriptional regulatory elements and/or to other amino acid encoding sequences. Such regulatory sequences are well known to those skilled in the art and include, without being limiting, regulatory sequences ensuring the initiation of transcription, internal ribosomal entry sites (IRES) (Owens, Proc. Natl. Acad. Sci. USA 98 (2001), 1471-1476) and optionally regulatory elements ensuring termination of transcription and stabilization of the transcript. Non-limiting examples for regulatory elements ensuring the initiation of transcription comprise a translation initiation codon, transcriptional enhancers such as e.g. the SV40-enhancer, insulators and/or promoters, such as for example the cytomegalovirus (CMV) promoter, SV40-promoter, RSV-promoter (Rous sarcome virus), the lacZ promoter, chicken beta-actin promoter, CAG-promoter (a combination of chicken beta-actin promoter and cytomegalovirus immediate-early enhancer), the gai10 promoter, human elongation factor 1α-promoter, AOX1 promoter, GAL1 promoter CaM-kinase promoter, the lac, trp or tac promoter, the lacUV5 promoter, the *autographa californica* multiple nuclear polyhedrosis virus (AcMNPV) polyhedral promoter or a globin intron in mammalian and other animal cells. Non-limiting examples for regulatory elements ensuring transcription termination include the V40-poly-A site, the tk-poly-A site or the SV40, lacZ or AcMNPV polyhedral polyadenylation signals, which are to be included downstream of the nucleic acid sequence of the invention. Additional regulatory elements may include translational enhancers, Kozak sequences and intervening sequences flanked by donor and acceptor sites for RNA splicing. Moreover, elements such as origin of replication, drug resistance gene or regulators (as part of an inducible promoter) may also be included.

Nucleic acid molecules encoding said Cas9 protein include DNA, such as cDNA or genomic DNA, and RNA. Preferably, embodiments reciting "RNA" are directed to mRNA.

It will be readily appreciated by the skilled person that more than one nucleic acid molecule may encode a Cas9 protein in accordance with the present invention due to the degeneracy of the genetic code. Degeneracy results because a triplet code designates 20 amino acids and a stop codon. Because four bases exist which are utilized to encode genetic information, triplet codons are required to produce at least 21 different codes. The possible $4^3$ possibilities for bases in triplets give 64 possible codons, meaning that some degeneracy must exist. As a result, some amino acids are encoded by more than one triplet, i.e. by up to six. The degeneracy mostly arises from alterations in the third position in a triplet. This means that nucleic acid molecules having different sequences, but still encoding the same Cas9 protein, can be employed in accordance with the present invention.

The nucleic acid molecules used in accordance with the present invention may be of natural as well as of (semi) synthetic origin. Thus, the nucleic acid molecules may, for example, be nucleic acid molecules that have been synthesised according to conventional protocols of organic chemistry. The person skilled in the art is familiar with the preparation and the use of said probes (see, e.g., Sambrook and Russel "Molecular Cloning, A Laboratory Manual", Cold Spring Harbor Laboratory, N.Y. (2001)).

Also in accordance with the present invention, the nucleic acid molecules used in accordance with the invention may be nucleic acid mimicking molecules known in the art such as synthetic or semi-synthetic derivatives of nucleic acid molecules and mixed polymers. They may contain additional non-natural or derivatised nucleotide bases, as will be readily appreciated by those skilled in the art. Nucleic acid mimicking molecules or nucleic acid derivatives according to the invention include, without being limiting, phosphorothioate nucleic acid, phosphoramidate nucleic acid, morpholino nucleic acid, hexitol nucleic acid (HNA), peptide nucleic acid (PNA) and locked nucleic acid (LNA).

In a second step, step (b), the remaining necessary components of the CRISPR/Cas system are introduced into the cell, namely (b-i) a target sequence specific CRISPR RNA (crRNA) and a trans-activating crRNA (tracr RNA) or a nucleic acid molecule encoding said RNAs; or (b-ii) a chimaeric RNA sequence comprising a target sequence specific crRNA and tracrRNA or a nucleic acid molecule encoding said RNA.

The term "target sequence specific CRISPR RNA (crRNA)", as used herein, has been described in the art, e.g. in Makarova et al. (2011). Nat Rev Microbiol 9:467-477; Makarova et al. (2011) Biol Direct 6:38; Bhaya et al. (2011) Annu Rev Genet 45:273-297; Barrangou R, Horvath P (2012) Annu Rev Food Sci Technol 3:143-162; Jinek et al. (2012) Science 337:816-821, Cong et al. (2013). Science 339:819-823; Mali et al. (2013) Science 339: 823-826 or Hwang et al. (2013); Nature Biotechnology doi:10.1038/nbt.2501. crRNAs differ depending on the Cas9 system but typically contain a target sequences of between 21 to 72 nucleotides length, flanked by two direct repeats (DR) of a length of between 21 to 46 nucleotides. In the case of *S. pyogenes*, the DRs are 36 nucleotides long and the target sequence is 30 nucleotides long (see FIGS. 3C and D, where white arrows indicate the DR sequence and the target sequence is located between these two DRs). The 3' located DR of the crRNA is complementary to and hybridizes with the corresponding tracr RNA, which in turn binds to the Cas9 protein. As described herein above, the genes encoding the three elements Cas9, tracrRNA and crRNA are typically organized in operon(s).

The preferred DR sequence for use with the *Streptococcus pyogenes* Cas9 protein (SEQ ID NO:2 and SEQ ID NO:14) is the sequence shown as SEQ ID NO:16.

DR sequences functioning together with Cas9 proteins of other bacterial species may be identified by bioinformatic analysis of sequence repeats occurring in the respective Crispr/Cas operons and by experimental binding studies of Cas9 protein and tracrRNA together with putative DR sequence flanked target sequences, as shown by (Deltcheva et al. (2011) Nature 471:602-607).

As used herein, the term "trans-activating crRNA (tracr RNA)" refers to a small RNA, that is complementary to and base pairs with a pre-crRNA, thereby forming an RNA duplex. This pre-crRNA is then cleaved by an RNA-specific ribonuclease, to form a crRNA/tracrRNA hybrid, which subsequently acts as a guide for the endonuclease Cas9, which cleaves the invading nucleic acid.

TracrRNAs functioning together with Cas9 proteins of other bacterial species may be identified by differential RNA sequencing, as first described by (Deltcheva et al. (2011) Nature 471:602-607).

The preferred tracrRNA sequence for use with the *Streptococcus pyogenes* Cas9 protein (SEQ ID NO:2 and SEQ ID NO:14) is the sequence shown as SEQ ID NO:4.

Alternatively, a chimaeric RNA sequence comprising such a target sequence specific crRNA and tracrRNA may be employed.

Such a chimaeric (ch) RNA may be designed by the fusion of a specific target sequence of 20 or more nt with a part or the entire DR sequence (defined as part of a crRNA) with the entire or part of a tracrRNA, as shown by (Jinek et al. Science 337:816-821). Within the chimaeric RNA a segment of the DR and the tracrRNA sequence are complementary able to hybridise and to form a hairpin structure.

The preferred chimaeric RNA sequence for use with the *Streptococcus pyogenes* Cas9 protein (SEQ ID NO:2 and SEQ ID NO:14) is the sequence shown as SEQ ID NO:6.

Moreover, the RNAs in accordance with step (b) may also be encoded by a nucleic acid molecule. The definitions and preferred embodiments recited above with regard to the nucleic acid molecule encoding the Cas9 protein apply mutatis mutandis also to the nucleic acid molecule encoding these RNAs.

In accordance with the method of the present invention, steps (a) and (b-i) or (b-ii) are either carried out concomitantly, i.e. at the same time or are carried out separately, i.e. at different time points. When the steps are carried out concomitantly, both the Cas9 protein and the RNAs of (b-i) or (b-ii), or nucleic acid molecules encoding same, can be introduced in parallel, for example using two separate injection needles or can be mixed together and, for example, be injected using one needle. When the Cas9 protein is introduced as a protein together with the RNAs of (b-i) or (b-ii), it is particularly preferred that a complex between the protein and the RNAs is formed prior to introduction into the oocyte, and said complex is then introduced into the oocyte, preferably into one or both pronuclei.

As described herein above, the Cas9 protein introduced in step (a) and the RNA sequence(s) introduced in step (b-i) or (b-ii) form a protein/RNA complex that specifically binds to the target sequence and introduces a single or double strand break within the target sequence.

In accordance with the present invention, the term "specifically binds to the target sequence" means that the Cas9 protein and tracr/cr/chRNAs are designed such that the complex statistically only binds to a particular sequence and does not bind to an unrelated sequence elsewhere in the genome. Methods for testing the DNA-binding specificity of a Cas9 protein/RNA complex in accordance with the present invention are known to the skilled person and include, without being limiting, transcriptional reporter gene assays and electrophoretic mobility shift assays (EMSA).

The term "introduces a single or double strand break within the target sequence" relates to the interruption of the DNA strand(s) of a DNA double helix, wherein either one of the two strands (single strand break) or both strands (double strand break) in the double helix are severed.

The presence of such a single or double strand break within the genomic DNA triggers intracellular repair mechanisms. Typically (but not exclusively), in the case of single strand breaks, such breaks are repaired by homologous recombination, while double strand breaks are typically repaired by either nonhomologous end joining (NHEJ) or homologous recombination.

Preferably, the binding site of the Cas9 protein/RNA complex in accordance with the invention is up to 500 nucleotides, such as up to 250 nucleotides, up to 100 nucleotides, up to 50 nucleotides, up to 25 nucleotides, up to 10 nucleotides such as up to 5 nucleotides upstream (i.e. 5') or downstream (i.e. 3') of the nucleotide(s) that is/are modified in accordance with the present invention.

In accordance with the present invention it was surprisingly found that it is possible to introduce gene modifications, including targeted gene modifications, into the genome of mammalian oocytes and to achieve an unexpectedly high frequency of homologous recombination of up to 10% by employing a generic Cas9 protein together with either a target specific pair of tracr/crRNA, or chimaeric RNA comprising said pair.

Performing the cleavage step of the method of the invention will frequently lead to spontaneous genome modifications through nucleotide loss associated with the repair of double strand breaks by nonhomologous end joining (NHEJ) repair. In addition, by providing a nucleic acid molecule comprising a donor nucleic acid sequence and regions homologous to the target sequence, targeted modification of a genome can be achieved with high specificity.

Several methods are known in the art for achieving an improved frequency of genetic modification. Such methods include, for example, the use of zinc finger or TAL nucleases for achieving homologous recombination.

However, as discussed herein above, the design and use of zinc finger proteins or TALENs requires considerable efforts and time. Furthermore, neighbouring zinc fingers generally influence each other. Thus, they cannot be simply combined into a larger protein in a combinatorial way in order to enhance sequence specificity. As a consequence, the addition of new zinc fingers to a preselected zinc finger protein requires a laborious screening and selection procedure for each individual step. Further, the incompletely known DNA binding code and the limited resources of coding zinc finger domains further hamper the design of nucleases fused to zinc finger proteins that are specific to any given DNA target sequence. In addition, the nuclease activity of newly derived TALEN pairs can vary more than 10-fold due to yet unknown principles of the TAL peptide DNA recognition (Reyon et al. (2012). *Nat Biotechnol* 30:460-465). Therefore, the design of specific zinc fingers or TALEN protein pairs is not straight forward and the use of either technique is typically associated with considerable efforts and time.

Another method employed to achieve a target sequence specific DNA double strand break is the use of yeast derived meganucleases, representing restriction enzymes like I-SceI that binds to specific 18 bp recognition sequence that does not occur naturally in mammalian genomes. However, a combinatorial code for the DNA binding specificity of meganucleases has not yet been revealed. The re-design of the DNA binding domain of meganucleases so far only allowed the substitution of one or a few nucleotides within their natural binding sequence (Pâques and Duchateau, 2007 Curr Gene Ther 7(1): 49-66). Therefore, the choice of meganuclease target sites is limited and it is presently not possible to design new meganucleases that bind to any preferred target region within mammalian genomes.

In contrast to these methods, the type II CRISPR-Cas technology solely requires the expression of the generic Cas9 nuclease protein in combination with one short, synthetic chimaeric RNA or two short, synthetic tracr/crRNAs that define the target specificity. Therefore, the CRISPR-Cas technology circumvents the laborious de novo construction of large TALEN proteins and instead requires the less time consuming in vitro transcription of one or two short RNAs, representing a considerable simplification in the generation of target specific single or double strand breaks.

As discussed herein above, mammalian zygotes could be regarded as a preferred substrate for genome engineering. However, due to the low efficiency of most genome manipulations, only the generation of transgenic mice by pronuclear DNA injection developed into a routine procedure. Further, it was reported that targeted gene manipulation in zygotes was associated not only with low recombination efficiency but also with a high number of spontaneously occurring, undesired mutations in the targeted allele (Brinster R L, Braun R E, Lo D, Avarbock M R, Oram F, Palmiter R D.; Proc Natl Acad Sci USA 1989; 86:7087-7091). Accordingly, it could have been assumed that the zygotic pronuclei are unfavorable for achieving targeted genetic manipulations.

Surprisingly it was found in accordance with the present invention that the type II CRISPR-Cas technology can be used to achieve targeted genetic manipulations in non-human, mammalian oocytes.

Thus, the method of the present invention of introducing genetic modifications into a target genome overcomes the above discussed problems currently faced by the skilled person. In particular, short target specific RNAs can be combined with the generic Cas9 nuclease to form a sequence-specific nuclease complex to generate single or double strand breaks in accordance with the present invention. Accordingly, any sequence of interest can now be targeted in a cost-effective, easy and fast way. Further, it was found in accordance with the present invention that the type II CRISPR-Cas technology can also be employed to achieve targeted genetic manipulations in non-human, mammalian oocytes and to produce a non-human mammal carrying a modified target sequence in its genome.

In a preferred embodiment, the oocytes are analysed for successful modification of the target genome. Methods for analysing for the presence or absence of a modification are well known in the art and include, without being limiting, assays based on physical separation of nucleic acid molecules, sequencing assays as well as cleavage and digestion assays and DNA analysis by the polymerase chain reaction (PCR).

Examples for assays based on physical separation of nucleic acid molecules include without limitation MALDI-TOF, denaturating gradient gel electrophoresis and other such methods known in the art, see for example Petersen et al., Hum. Mutat. 20 (2002) 253-259; Hsia et al., Theor. Appl. Genet. 111 (2005) 218-225; Tost and Gut, Clin. Biochem. 35 (2005) 335-350; Palais et al., Anal. Biochem. 346 (2005) 167-175.

Examples for sequencing assays comprise, without limitation, approaches of sequence analysis by direct sequencing, fluorescent SSCP in an automated DNA sequencer and Pyrosequencing. These procedures are common in the art, see e.g. Adams et al. (Ed.), "Automated DNA Sequencing and Analysis", Academic Press, 1994; Alphey, "DNA Sequencing: From Experimental Methods to Bioinformatics", Springer Verlag Publishing, 1997; Ramon et al., J. Transl. Med. 1 (2003) 9; Meng et al., J. Clin. Endocrinol. Metab. 90 (2005) 3419-3422.

Examples for cleavage and digestion assays include without limitation restriction digestion assays such as restriction fragments length polymorphism assays (RFLP assays), RNase protection assays, assays based on chemical cleavage methods and enzyme mismatch cleavage assays, see e.g. Youil et al., Proc. Natl. Acad. Sci. U.S.A. 92 (1995) 87-91; Todd et al., J. Oral Maxil. Surg. 59 (2001) 660-667; Amar et al., J. Clin. Microbiol. 40 (2002) 446-452.

Alternatively, instead of analyzing the oocytes for the presence or absence of the desired modification, successfully modified oocytes may be selected by incorporation of appropriate selection markers. Selection markers include positive and negative selection markers, which are well known in the art and routinely employed by the skilled person. Non-limiting examples of selection markers include dhfr, gpt, neomycin, hygromycin, dihydrofolate reductase, G418 or glutamine synthase (GS) (Murphy et al., Biochem J. 1991, 227:277; Bebbington et al., Bio/Technology 1992, 10:169). Using these markers, the oocytes are grown in selective medium and the oocytes with the highest resistance are selected. Also envisaged are combined positive-negative selection markers, which may be incorporated into the target genome by homologous recombination or random integration. After positive selection, the first cassette comprising the positive selection marker flanked by recombinase recognition sites is exchanged by recombinase mediated cassette exchange against a second, marker-less cassette. Clones containing the desired exchange cassette are then obtained by negative selection.

In a preferred embodiment of the method of the invention, the target sequence is modified by homologous recombination with a donor nucleic acid sequence further comprising the step: (c) introducing a nucleic acid molecule into the cell, wherein the nucleic acid molecule comprises the donor nucleic acid sequence and regions homologous to the target sequence.

The term "homologous recombination", as employed herein, is used according to the definitions provided in the art. Thus, it refers to a mechanism of genetic recombination in which two DNA strands comprising similar nucleotide sequences exchange genetic material. Cells use homologous recombination during meiosis, where it serves to rearrange DNA to create an entirely unique set of haploid chromosomes, but also for the repair of damaged DNA, in particular for the repair of single and double strand breaks. The mechanism of homologous recombination is well known to the skilled person and has been described, for example by Paques and Haber (Paques F, Haber J E.; Microbiol Mol Biol Rev 1999; 63:349-404)

In accordance with the present invention, the term "donor nucleic acid sequence" refers to a nucleic acid sequence that serves as a template in the process of homologous recombination and that carries the modification that is to be introduced into the target sequence. By using this donor nucleic acid sequence as a template, the genetic information, including the modifications, is copied into the target sequence within the genome of the oocyte. In non-limiting examples, the donor nucleic acid sequence can be essentially identical to the part of the target sequence to be replaced, with the exception of one nucleotide which differs and results in the introduction of a point mutation upon homologous recombination or it can consist of an additional gene previously not present in the target sequence. The donor nucleic acid sequence may be a double stranded nucleic acid sequence or a single-stranded nucleic acid molecule.

In accordance with the method of the present invention of producing a non-human, mammalian oocyte carrying a modified target sequence in its genome, the nucleic acid molecule introduced into the cell in step (c) comprises the donor nucleic acid sequence as defined above as well as additional regions that are homologous to the target sequence, or to parts of the target sequence.

The term "regions homologous to the target sequence" (also referred to as "homology arms" herein), in accordance with the present invention, refers to regions having sufficient sequence identity to ensure specific binding to the target sequence. Methods to evaluate the identity level between two nucleic acid sequences are well known in the art. For example, the sequences can be aligned electronically using suitable computer programs known in the art. Such programs comprise BLAST (Altschul et al. (1990) J. Mol. Biol. 215, 403), variants thereof such as WU-BLAST (Altschul and Gish (1996) Methods Enzymol. 266, 460), FASTA (Pearson and Lipman (1988) Proc. Natl. Acad. Sci. USA 85, 2444) or implementations of the Smith-Waterman algorithm (SSEARCH, Smith and Waterman (1981) J. Mol. Biol., 147, 195). These programs, in addition to providing a pairwise sequence alignment, also report the sequence identity level (usually in percent identity) and the probability for the occurrence of the alignment by chance (P-value). In accordance with the present invention it is preferred that BLAST is used to determine the identify level between two nucleic acid sequences.

Preferably, the "regions homologous to the target sequence" have a sequence identity with the corresponding part of the target sequence of at least 95%, more preferred at least 97%, more preferred at least 98%, more preferred at least 99%, even more preferred at least 99.9% and most preferred 100%. The above defined sequence identities are defined only with respect to those parts of the target sequence which serve as binding sites for the homology arms. Thus, the overall sequence identity between the entire target sequence and the homologous regions of the nucleic acid molecule of step (c) of the method of the present invention can differ from the above defined sequence identities, due to the presence of the part of the target sequence which is to be replaced by the donor nucleic acid sequence. It is preferred that at least two regions homologous to the target sequence are present in the nucleic acid molecule of (c).

In accordance with this preferred embodiment of the method of the present invention, steps (a) and (b-i) or (b-ii) as well as step (c) are either carried out concomitantly, i.e. at the same time or are carried out at different time points. For example, all three steps can be carried out concomitantly, for example using three separate injection needles or in form of a mixture that is injected using one needle. Alternatively, steps (a) and (b-i)/(b-ii) can be carried out concomitantly, while step (c) is carried out at a different (earlier or later) time point. Also, step (c) may be carried out concomitantly with step (a) and step (b-i)/(b-ii) is carried out at a different (earlier or later) time point. Furthermore, step (c) may also be carried out concomitantly with step (b-i)/(b-ii) while step (a) is carried out at a different (earlier or later) time point.

Accordingly, it will also be appreciated by one of skill in the art that the nucleic acid molecule to be introduced into the cell in step (c) and a nucleic acid molecule encoding the Cas9 protein and/or a nucleic acid molecule encoding the RNAs of step (b-i) or (b-ii) may be comprised in one nucleic acid sequence, for example in one vector or plasmid. Alternatively, the nucleic acid molecule of step (c) may be a further nucleic acid molecule, to be introduced in addition to the nucleic acid molecule(s) in accordance with step (a) and/or (b-i) or (b-ii).

In a more preferred embodiment of the method of the invention, the nucleic acid molecule of step (c) is a single stranded oligodesoxynucleotide.

The term "oligodesoxynucleotide (ODN)" relates to a nucleic acid polymer made up of a sequence of desoxynucleotide residues. An ODN in accordance with the present invention refers to both oligodesoxynucleotides and polydesoxynucleotides and is at least 30 nucleotides in length, such as e.g. at least 40 nucleotides in length, e.g. at least 50 nucleotides in length, such as e.g. at least 60 nucleotides in length, more preferably at least 70 nucleotides in length, such as e.g. at least 80 nucleotides in length, e.g. at least 90 nucleotides in length and even more preferably at least 100 nucleotides in length, such as e.g. at least 110 nucleotides in length, e.g. at least 120 nucleotides in length, e.g. at least 130 nucleotides in length, such as at least 140 nucleotides in length and most preferably at least 150 nucleotides in length. It is further preferred that the ODN in accordance with the present invention is less than 500 nucleotides in length, such as e.g. less than 400 nucleotides in length, e.g. less than 300 nucleotides in length and most preferably less than 200 nucleotides in length.

Moreover, the oligodesoxynucleotide in accordance with this preferred embodiment is a single-strand ODN (ssODN), i.e. it is not hybridised with a second, different (i.e. complementary or partially complementary) oligonucleotide strand. Nonetheless, it will be appreciated that the ssODN may fold back onto itself, thus forming a partial or complete double stranded molecule consisting of one oligodesoxynucleotide strand. Preferably, the ssODN in accordance with this preferred embodiment does not fold back to form a partial or complete double stranded molecule but instead is single-stranded over its entire length.

In another preferred embodiment of the method of the invention, the oocyte is a fertilised oocyte.

In a further preferred embodiment of the method of the invention, the Cas9 protein or the nucleic acid molecule encoding same and/or the RNA of (b-i) or (b-ii) or the nucleic acid molecule encoding said RNA is/are introduced into the oocyte by microinjection.

Microinjection into the oocyte can be carried out by injection into the nucleus (before fertilisation), the maternal and/or paternal pronucleus (after fertilisation) and/or by injection into the cytoplasm (both before and after fertilisation). When a fertilised oocyte is employed, injection into the pronucleus is carried out either for one pronucleus or for both pronuclei. Preferably, for injection into only one of the pronuclei, the paternal pronucleus is chosen due to its bigger size.

Injection of the Cas9 protein of step (a) or of the RNA of step (b-i) or (b-ii) is preferably into the cytoplasm, while injection of a nucleic acid molecule encoding said protein or RNA is preferably into the nucleus/pronucleus, in the case of fertilized oocytes preferably into both pronuclei. It is more preferred that the microinjection is carried out by injection into both the nucleus/pronucleus and the cytoplasm. For example, the needle can be introduced into the nucleus/pronucleus and a first amount of the Cas9 protein of step (a) and/or of the RNA of step (b-i) or (b-ii) and/or of a nucleic acid molecule encoding same are injected into the nucleus/pronucleus. While removing the needle from the oocyte, a second amount of the Cas9 protein of step (a) and/or of the RNA of step (b-i) or (b-ii) and/or of a nucleic acid molecule encoding same is injected into the cytoplasm. When a nucleic acid molecule that needs to be present in the nucleus/pronucleus, such as e.g. a DNA molecule encoding the Cas9 protein, is injected into the cytoplasm, then said nucleic acid molecule should comprise a nuclear localisation signal to ensure delivery into the nucleus/pronucleus.

Methods for carrying out microinjection are well known in the art and are described for example in Nagy et al. (Nagy A, Gertsenstein M, Vintersten K, Behringer R., 2003. Manipulating the Mouse Embryo. Cold Spring Harbour, N.Y.: Cold Spring Harbour Laboratory Press) as well as in the examples herein below.

In another preferred embodiment of the method of the invention, the nucleic acid molecule of step (c) is introduced into the oocyte by microinjection.

Injection of the nucleic acid molecule of step (c) is preferably into the nucleus/pronucleus. However, injection of the nucleic acid molecule of step (c) can also be carried out into the cytoplasm when said nucleic acid molecule is provided as a nucleic acid sequence having a nuclear localisation signal, as mentioned above.

In another preferred embodiment of the method of the invention, the nucleic acid molecule encoding the Cas9 protein is mRNA.

In a further preferred embodiment of the method of the invention, the Cas9 protein has an amino acid sequence as shown in SEQ ID NO:2.

The amino acid sequence of SEQ ID NO:2 represents a Cas9 protein derived from *Streptococcus pyogenes*.

In another preferred embodiment of the method of the invention, the regions homologous to the target sequence are localised at the 5' and 3' ends of the donor nucleic acid sequence.

In this preferred embodiment, the donor nucleic acid sequence is flanked by the two regions homologous to the target sequence such that the nucleic acid molecule used in the method of the present invention consists of a first region homologous to the target sequence, followed by the donor nucleic acid sequence and then a second region homologous to the target sequence.

In a further preferred embodiment of the method of the invention, the regions homologous to the target sequence comprised in the nucleic acid molecule of (c) have a length of at least 400 bp. More preferably, the regions each have a length of at least 500 nucleotides, such as at least 600 nucleotides, at least 750 bp nucleotides, more preferably at least 1000 nucleotides, such as at least 1500 nucleotides, even more preferably at least 2000 nucleotides and most preferably at least 2500 nucleotides. It will be appreciated that these minimum lengths refer to the lengths of each of the homologous regions present in the nucleic acid molecule of (c), i.e. where two homologous regions are present, each homologous independently has a length of at least 400 bp, 500 bp etc., wherein the homologous regions may have the same or different lengths, as long as they each have the recited minimum length. The maximum length of the regions homologous to the target sequence comprised in the nucleic acid molecule depends on the type of cloning vector used and can usually be up to a length 20.000 nucleotides each in *E. coli* high copy plasmids using the col EI replication origin (e.g. pBluescript) or up to a length of 300.000 nucleotides each in plasmids using the F-factor origin (e.g. in BAC vectors such as for example pTARBAC1).

In a further preferred embodiment of the method of the invention, the modification of the target sequence is selected from the group consisting of substitution, insertion and deletion of at least one nucleotide of the target sequence. Preferred in accordance with the present invention are substitutions, for example substitutions of 1 to 3 nucleotides and insertions of exogenous sequences, such as loxP sites (34 nucleotides long) or cDNAs, such as for example for reporter genes. Such cDNAs for reporter genes can, for example, be up to 6 kb long. Depending on the purpose of the modification, the modifications should be in frame or should lead to a frame shift. The person skilled in the art would know how to ensure that the reading frame is maintained or shifted and would also be aware which alternative is desirable in a particular case.

In another preferred embodiment of the method of the invention, the oocyte is from a non-human mammal selected from the group consisting of rodents, dogs, felids, primates, rabbits, pigs, and ruminants.

All of the mammals, avians and fish described herein are taxonomically defined in accordance with the prior art and the common general knowledge of the skilled person.

Non-limiting examples of "rodents" are mice, rats, squirrels, chipmunks, gophers, porcupines, beavers, hamsters, gerbils, guinea pigs, degus, chinchillas, prairie dogs, and groundhogs.

Non-limiting examples of "dogs" include members of the subspecies *canis lupus familiaris* as well as wolves, foxes, jackals, and coyotes.

Non-limiting examples of "felides" include members of the two subfamilies: the pantherinae, including lions, tigers, jaguars and leopards and the felinae, including cougars, cheetahs, servals, lynxes, caracals, ocelots and domestic cats.

The term "primates", as used herein, refers to all monkeys including for example cercopithecoid (old world monkey) or platyrrhine (new world monkey) as well as lemurs, tarsiers, apes and marmosets (*Callithrix jacchus*).

The present invention also relates to a method of producing a non-human mammal carrying a modified target sequence in its genome, the method comprising: (a) producing an oocyte in accordance with any one of claims 1 to 12; (b) transferring the oocyte obtained in (a) to a pseudopregnant female host; and (c) analysing the offspring delivered by the female host for the presence of the modification.

In accordance with the present invention, the term "transferring the oocyte obtained in (a) to a pseudopregnant female host" includes the transfer of a fertilised oocyte but also the transfer of pre-implantation embryos of for example the 2-cell, 4-cell, 8-cell, 16-cell and blastocyst (70- to 100-cell) stage. Said pre-implantation embryos can be obtained by culturing the oocyte under appropriate conditions for it to develop into a pre-implantation embryo. Furthermore, the oocyte may be injected into a blastocyst or fused with a blastocyst in order to obtaining a pre-implantation embryo. Methods of introducing an oocyte into a blastocyst as well as methods for transferring an oocyte or pre-implantation embryo to a pseudo-pregnant female host are well known in the art and are, for example, described in Nagy et al., (Nagy A, Gertsenstein M, Vintersten K, Behringer R., 2003. Manipulating the Mouse Embryo. Cold Spring Harbour, N.Y.: Cold Spring Harbour Laboratory Press).

It is further envisaged in accordance with the method of producing a non-human mammal carrying a modified target sequence in its genome that a step of analysis of successful genomic modification is carried out before transplantation into the female host. As a non-limiting example, the oocyte can be cultured to the 2-cell, 4-cell or 8-cell stage and one cell can be removed without destroying or altering the resulting embryo. Analysis for the genomic constitution, e.g. the presence or absence of the genomic modification, can then be carried out using for example PCR or southern blotting techniques or any of the methods described herein above. Such methods of analysis of successful genotyping prior to transplantation are known in the art and are described, for example in Peippo et al. (Peippo J, Viitala S, Virta J, Raty M, Tammiranta N, Lamminen T, Aro J, Myllymaki H, Vilkki J.; Mol Reprod Dev 2007; 74:1373-1378).

For this method of producing a non-human mammal, fertilisation of the oocyte is required. Said fertilisation can occur before the modification of the target sequence in step (a) in accordance with the method of producing a non-human vertebrate or mammal of the invention, i.e. a fertilised oocyte can be used for the method of modifying a target sequence in accordance with the invention. The fertilisation can also be carried out after the modification of the target sequence in step (a), i.e. a non-fertilised oocyte can be used for the method of modifying a target sequence in accordance with the invention, wherein the oocyte is subsequently fertilised before transfer into the pseudopregnant female host.

The step of analysing for the presence of the modification in the offspring delivered by the female host provides the necessary information whether or not the produced non-human mammal carries the modified target sequence in its genome. Thus, the presence of the modification is indicative of said offspring carrying a modified target sequence in its genome whereas the absence of the modification is indicative of said offspring not carrying the modified target sequence in its genome. Methods for analysing for the presence or absence of a modification have been detailed above. Those offspring carrying the modified target sequence in their genome can then be further bred in order to determine whether the introduced modification is passed on to offspring via germline transmission. Those mammals in which germline transmission of the modification is successful can then be used for further breeding.

The non-human mammal produced by the method of the invention is, inter alia, useful to study the function of genes of interest and the phenotypic expression/outcome of modifications of the genome in such animals. It is furthermore envisaged that the non-human mammals of the invention can be employed as disease models for human familial amyotrophic lateral sclerosis, frontotemporal demential, Parkinson's disease, Alzheimer's disease and any other genetically caused diseases and for testing therapeutic agents/compositions. Furthermore, the non-human mammal of the invention can also be used for livestock breeding.

In a preferred embodiment of this method of the invention of producing a non-human mammal, the non-human mammal is selected from the group consisting of rodents, dogs, felids, primates, rabbits, pigs and ruminants.

The present invention further relates to a non-human mammalian animal obtainable by the above described method of the invention.

All the definitions and preferred embodiments defined above with regard to the method of the invention of producing a non-human, mammalian oocyte carrying a modified target sequence in its genome apply mutatis mutandis also to this method of the invention of producing a non-human mammal.

Figure 3:
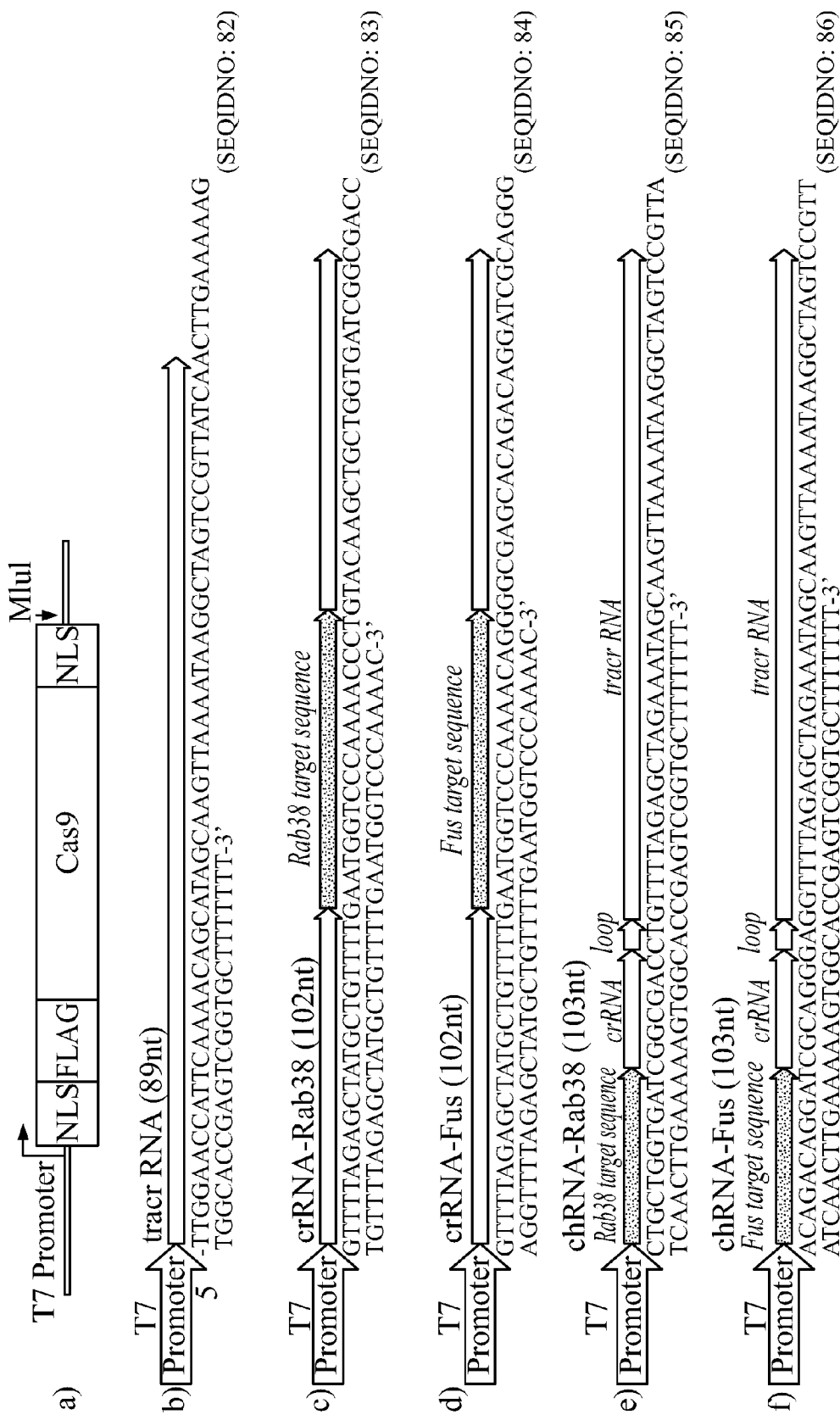
FIG. 3: DNA constructs of the invention for the production of Cas9 mRNA, tracrRNA, crRNAs and chRNAs. (a) Plasmid pCAG-Cas9-bpA contains a T7 RNA polymerase promoter upstream of a codon-optimized coding region of Cas9 from the *Streptococcus pyogenes* type II CRISPR locus, modified by the addition of N- and C-terminal nuclear localisation sequences (NLS) and a FLAG tag, followed by a MluI restriction site for linearization. (b) Plasmid pT7-tracrRNA contains a T7 promoter upstream of the indicated sequence enabling the in vitro transcription of the 89 nucleotide tracrRNA. (c) Plasmid pT7-crRNA-Rab38 contains a T7 promoter upstream of the indicated 102 nucleotide sequence, enabling the in vitro transcription of crRNA-Rab38 that includes a 30 nt target sequence from exon 1 of the mouse Rab38 gene, flanked by two 36 nt direct repeat (DR) sequences from the *Streptococcus pyogenes* type II CRISPR locus. (d) Plasmid pT7-crRNA-Fus contains a T7 promoter upstream of the indicated 102 nucleotide sequence, enabling the in vitro transcription of crRNA-Fus that includes a 30 nt target sequence from exon 15 of the mouse Fus gene, flanked by two 36 nt DR sequences from the *Streptococcus pyogenes* type II CRISPR locus. (e) Plasmid pT7-chRNA-Rab38 contains a T7 promoter upstream of the indicated 103 nucleotide sequence, enabling the in vitro transcription of chRNA-Rab38 that includes a 20 nt target sequence from exon 1 of the mouse Rab38 gene and a chimaeric RNA sequence derived from the crRNA (c) and tracr RNA (b). (f) Plasmid pT7-chRNA-Fus contains a T7 promoter upstream of the indicated 103 nucleotide sequence, enabling the in vitro transcription of chRNA-Fus that includes a 20 nt target sequence from exon 15 of the mouse Fus gene and a chimaeric RNA sequence derived from the crRNA (c) and tracr RNA (b).
Figure 4:
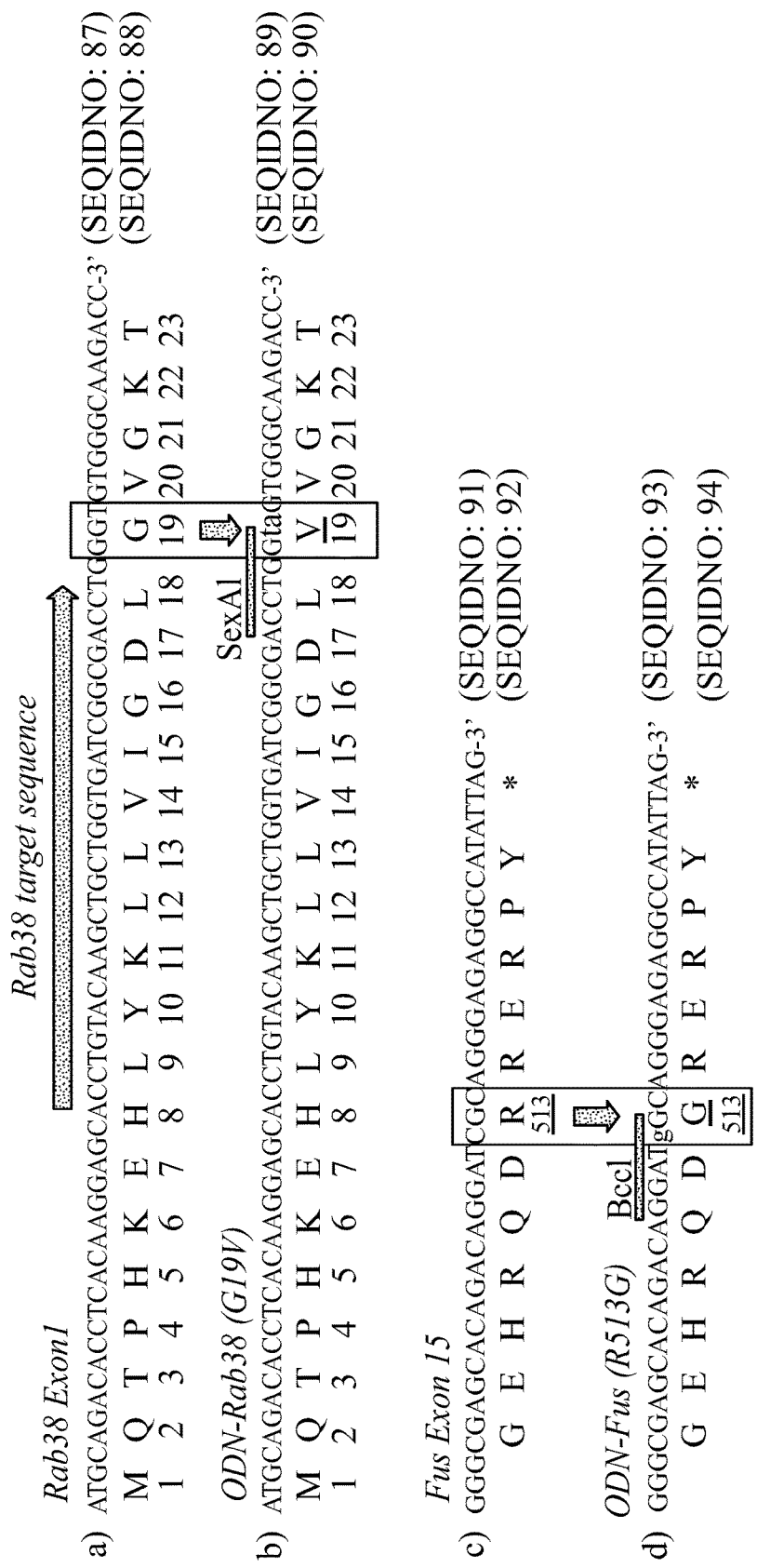

FIG. 4. Targeted mutations in the murine Rab38 and Fus genes. (a) Codons 1-23 of the mouse Rab38 gene. (b) Using the mutagenic oligodeoxynucleotide ODN-Rab38 (G19V) as repair template for Cas9, tracrRNA/crRNA-Rab38 or chRNA-Rab38 (FIG. 3) induced double-strand breaks within the indicated target region in one-cell embryos, a glycine to valine replacement and a SexAI site are created at codon 19. (c) Codons of exon15 of the mouse Fus gene. (d) Using the mutagenic oligodeoxynucleotide ODN-Fus (R513G) as repair template for Cas9, tracrRNA/crRNA-Fus or chRNA-Fus (FIG. 3) induced double-strand breaks within the indicated target region in one-cell embryos, an arginine to glycine replacement and a BccI site are created at codon 513.

The examples illustrate the invention.

EXAMPLE 1

Figure 1:
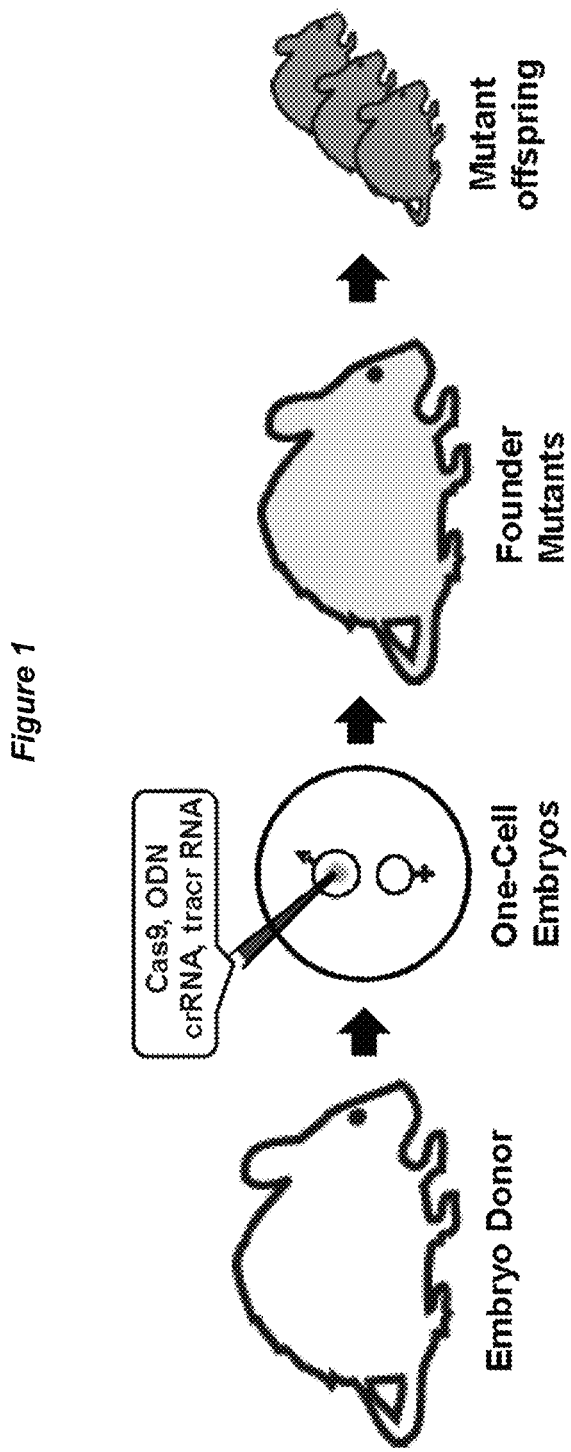
FIG. 1: Schematic outline of Crispr/Cas9-mediated germline modification of mice. An exemplary workflow of Crispr/Cas9-mediated, embryo based gene targeting is shown which starts with the microinjection of Cas9 mRNA, tracrRNA, crRNA, and optionally, of a synthetic, mutagenic oligodeoxynucleotide (ODN), into one or both pronuclei of one-cell embryos isolated from donor females. Upon translation, the Cas9 protein is imported into the pronuclei and creates together with the crRNA and tracrRNA a (single or) double strand break (DSB) in the target gene of the paternal and maternal genome (FIG. 2). The DSBs are either processed by error-prone NHEJ repair (possible in both paternal and maternal genomes), or are repaired by homologous recombination in those cases and genomes into which a mutagenic ODN has been introduced. Upon transfer of the microinjected embryos into foster females, the offspring derived is genotyped by PCR as well as sequence analysis to identify founder animals that harbor targeted or knockout mutations in their germline. The mating of such founders to wildtype mice produces heterozygous mutants that are intercrossed to obtain homozygote mutants.
Figure 2:
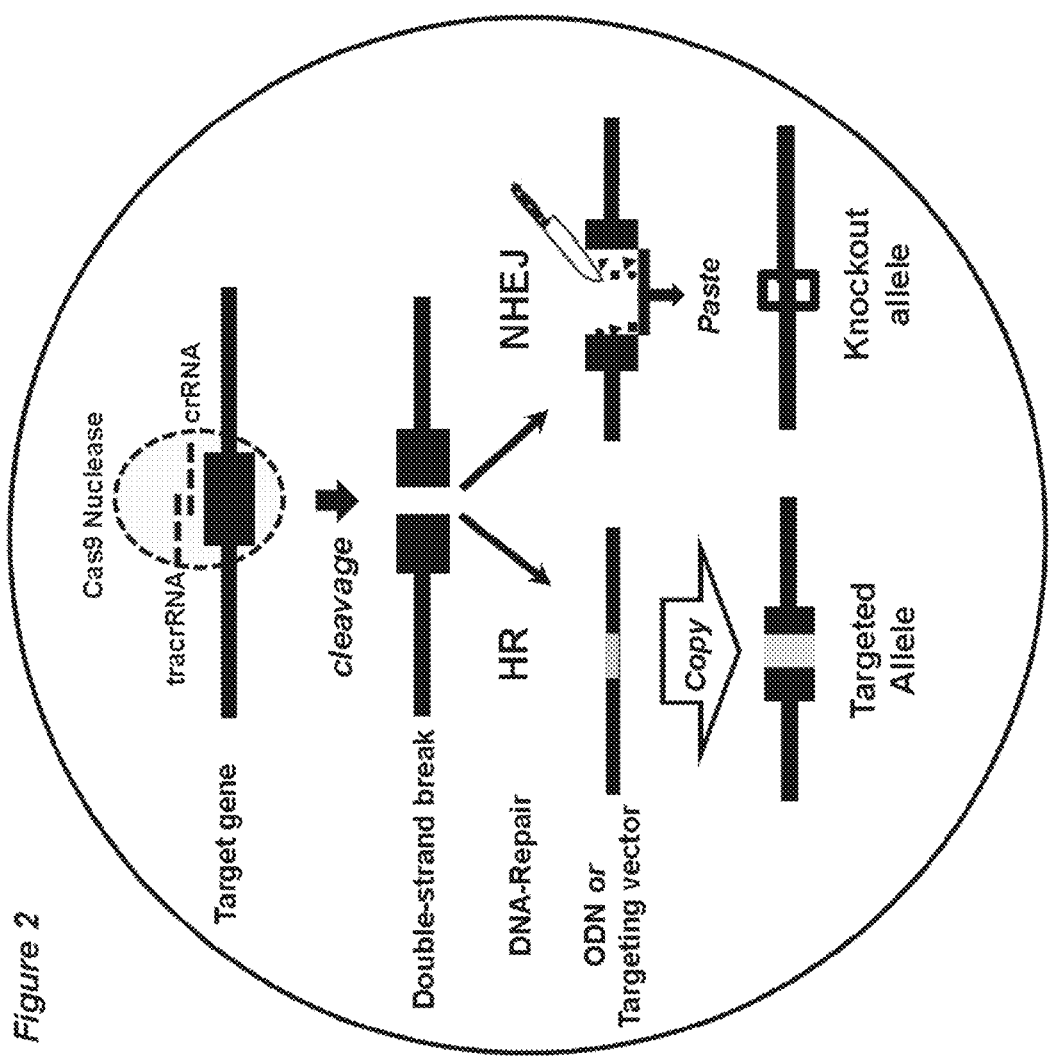
FIG. 2: Crisp/Cas9-mediated gene editing in pronuclei of microinjected one-cell embryos. Double-strand breaks (DSBs) induced by Cas9, crRNA and tracrRNA enhance DNA repair at the target site by several orders of magnitude. DSBs may be repaired by the homologous recombination (HR) pathway using a synthetic oligonucleotide or a gene targeting vector as repair template, that contain a desired genetic modification flanked with sequence homology regions. In the recombination process, gene conversion extends from the vector's homology regions into the heterologous sequence and transfers the modification into the genome (targeted allele). Alternatively, DSBs can be closed by the non-homologous end joining (NHEJ) pathway that re-ligates the open DNA ends without repair templates. By this means, DNA ends are frequently edited through loss of multiple nucleotides causing in many cases frameshift (knockout) mutations within coding regions.

Generation of Knockout and Knockin Mutations in the Rab38 and Fus Genes by Cas9, and tracrRNA/crRNAs or chRNAs in Mouse One-Cell Embryos The workflow of Crispr/Cas9-mediated, embryo based gene targeting with the microinjection of Cas9 mRNA, tracrRNA/crRNA or chimaericRNA (chRNA) and optional, of a synthetic oligodeoxynucleotide (ODN), into the paternal pronucleus of one-cell embryos isolated from donor females. Upon translation, the Cas9 nuclease protein is imported into the pronuclei and creates together with the target specific crRNA and generic tracrRNA or with the target specific chRNA, a double strand break in the target gene of the paternal and maternal genome (FIG. 1). In the paternal genome, DSBs are sealed either by homologous recombination with the mutagenic ODN or become processed in both genomes by error-prone NHEJ repair, creating knockin or knockout alleles (FIG. 2). Upon transfer of the microinjected embryos into foster females, the offspring derived is genotyped by PCR and sequence analysis to identify founder animals that harbor targeted or knockout mutations in their germline. The mating of such founders to wildtype mice produces heterozygous mutants that are intercrossed to obtain homozygote mutants.

As proof of this principle, the Rab38 gene was targeted to create a glycine-to-valine missense mutation at codon 19 (G19V), as found in the Rab38$^{cht}$ allele of chocolate mutants (Loftus et al. (2002) *Proc Natl Acad Sci USA* 99:4471-4476). The Rab38 gene encodes a small GTPase that regulates intracellular vesicle trafficking in melanocytes, retinal pigment epithelial cells, alveolar pneumocytes and platelets (Wasmeier et al. (2006) *J Cell Biol* 175:271-281). Mutant chocolate mice (Rab38$^{cht}$) exhibit a missense and ruby rats a nonsense mutation within Rab38 and are considered to be phenotypic models of Hermansky-Pudlak syndrome; a disease characterized by oculocutaneous albinism (OCA), progressive pulmonary fibrosis and platelet storage disease (Oiso et al. (2004) *Mamm Genome* 15:307-314; Di Pietro et al. (2005) *Traffic* 6:525-33; Lopes V S et al. (2007). *Mol Biol Cell* 18:3914-3927; Osanai et al. (2010) *Am J Physiol Lung Cell Mol Physiol* 298:L243-251).

As targeting molecule a synthetic, single-stranded oligodeoxynucleotide ODN-Rab38(G19V) of 144 nucleotides (SEQ ID NO:1) was used that covers 47 bp of the lagging strand sequence upstream of codon 19 and 94 bp of downstream sequence. ODN-Rab38 (G19V) includes a G to T replacement at the second position of codon 19, creating a valine triplet and a SexAI restriction site, and a silent T to A exchange as an unique identifier of the targeted Rab38 allele (FIG. 4).

ODN-Rab38 (G19V) was microinjected together with Cas9 mRNA coding for a modified Cas9 protein (SEQ ID NO:2), transcribed from pCAG-Cas9-bpA (SEQ ID NO:3), and tracrRNA, transcribed from pT7-tracr-RNA (SEQ ID NO:4) and crRNA-Rab38, transcribed from pT7-crRNA-Rab38 (SEQ ID NO:5), or together with Cas9 mRNA and chRNA-Rab38 (SEQ ID NO:6) (FIG. 3) into one-cell mouse embryos (FIG. 1). The resulting offspring was analysed for gene editing events by PCR amplification of a 213 bp region covering the first exon of Rab38 from genomic tail DNA.

Founder mice harbouring the G19V replacement were initially identified by the digestion of PCR products with SexAI. The presence of digested PCR products identified a substantial fraction of the pups derived from microinjections of both, crRNA-Rab38/tracrRNA and chRNA-Rab38, as recombined founders. Subsequently, undigested PCR products from such founders were subcloned and 10 subclones analysed by sequencing. This analysis revealed the presence of Rab38 alleles harboring the G19V replacement but also of knockout alleles that lost a variable number of nucleotides due to NHEJ repair. By further breeding of such founder mice the mutant Rab38 alleles can be transferred via the germ line and enable the establishment of mutant mouse lines.

Furthermore, the Fus gene was targeted to create an arginine-to-glycine missense mutation at codon 513 (R513G), as found in the mutant Fus alleles of familial amyotrophic lateral sclerosis (ALS) patients, causing the loss of motor neurons and the nuclear and cytoplasmic aggregation of FUS. FUS is a nucleoprotein that functions in regulation of transcription, splicing, and RNA export. The majority of mutations occur in the C-terminal tail harboring a nuclear localization signal, such that Fus R513G mouse mutants provide a disease model for familial ALS (Van Langenhove et al. (2012) *Ann Med* 44:817-828; Fiesel F C, Kahle P J (2011) TDP *FEBS J* 278:3550-3568).

As targeting molecule, a synthetic, single-stranded oligodeoxynucleotide ODN-Fus(R513G) of 140 nucleotides (Seq ID NO:7) was used that covers exon 15 of the mouse Fus gene. ODN-Fus-(R513G) includes a C to G replacement at the first position of codon 513, creating a glycine triplet and a BccI restriction site (FIG. 4). ODN-Fus (R513G) was microinjected together with Cas9 mRNA coding for a modified Cas9 protein in (SEQ ID NO:2), transcribed from pCAG-Cas9-bpA (SEQ ID NO:3), and tracrRNA, transcribed from pT7-tracr-RNA (SEQ ID NO:4) and crRNA-Fus, transcribed from pT7-crRNA-Fus (SEQ ID NO:8), or together with Cas9 mRNA and chRNA-Fus (SEQ ID NO:9) (FIG. 3) into one-cell mouse embryos (FIG. 1). The resulting offspring was analysed for gene editing events by PCR amplification of a 576 bp region covering exon 15 of Fus from genomic tail DNA. Founder mice harbouring the R513G replacement were initially identified by the digestion of PCR products with BccI. The presence of digested PCR products identified a substantial fraction of the pups derived from microinjections of both, crRNA-Fus/tracrRNA and chRNA-Fus, as recombined founders. Subsequently, undigested PCR products from such founders were subcloned and 10 subclones analysed by sequencing. This analysis revealed the presence of Fus alleles harboring the R513G replacement but also of knockout alleles that lost a variable number of nucleotides due to NHEJ repair. By further breeding of such founder mice the mutant Fus alleles can be transferred via the germ line and enable the establishment of mutant mouse lines.

Methods

Plasmid Constructions

DNA constructs pT7-tracrRNA, pT7-crRNA-Rab38, pT7crRNA-Fus, pT7chRNA-Rab38 and pT7-chRNA-Fus for the in vitro transcription of short RNAs (FIG. 3) were obtained by DNA synthesis (Genscript, Piscataway, USA), cloned into plasmid pUC57. crRNAs were designed to recognize target sequences in genomic sequences that are located upstream of the *Streptococcus pyogenes* SF370 type II CRISPR locus PAM sequence "NGG". Plasmid pCAG-Cas9-bpA (SEQ ID NO:3) was constructed by ligation of a PacI-MluI fragment containing a synthetic Cas9 coding region (Genscript, Piscataway, USA) into the corresponding sites of plasmid pCAG-venus-MluI. Plasmid pCAG-Cas9-bpA contains a T7 RNA polymerase promoter upstream of a codon-optimized coding region of Cas9 from the *Streptococcus pyogenes* type II CRISPR locus, modified by the addition of N- and C-terminal nuclear localisation sequences (NLS) and a FLAG tag, followed by a MluI restriction site for linearization. Plasmid pT7-tracrRNA (SEQ ID NO:4) contains a T7 promoter upstream of the indicated sequence enabling the in vitro transcription of the 89 nucleotide tracrRNA. Plasmid pT7-crRNA-Rab38 (SEQ ID NO:5) contains a T7 promoter upstream of the indicated 102 nucleotide sequence, enabling the in vitro transcription of crRNA-Rab38 that includes a 30 nt target sequence from exon 1 of the mouse Rab38 gene, flanked by two 36 nt direct repeat (DR) sequences from the *Streptococcus pyogenes* type II CRISPR locus. Plasmid pT7-crRNA-Fus (SEQ ID NO:8) contains a T7 promoter upstream of the indicated 102 nucleotide sequence, enabling the in vitro transcription of crRNA-Fus that includes a 30 nt target sequence from exon 15 of the mouse Fus gene, flanked by two 36 nt DR sequences from the *Streptococcus pyogenes* type II CRISPR locus. Plasmid pT7-chRNA-Rab38 (SEQ ID NO:6) contains a T7 promoter upstream of the indicated 103 nucleotide sequence, enabling the in vitro transcription of chRNA-Rab38 that includes a 20 nt target sequence from exon 1 of the mouse Rab38 gene and a chimaeric RNA sequence derived from the crRNA and tracr RNA (FIG. 3). Plasmid pT7-chRNA-Fus (SEQ ID NO:9) contains a T7 promoter upstream of the indicated 103 nucleotide sequence, enabling the in vitro transcription of chRNA-Fus that includes a 20 nt target sequence from exon 15 of the mouse Fus gene and a chimaeric RNA sequence derived from the crRNA and tracr RNA (FIG. 3).

Microinjection of One-Cell Embryos

The injection of Cas9 mRNA, of tracrRNA/crRNA or chRNAs and targeting ODNs was performed as previously described for ZFNs (Meyer et al. (2010) *Proc Natl Acad Sci USA* 107:15022-6; Meyer et al. (2012) *Proc Natl Acad Sci USA* 109:9354-9359). Briefly, Cas9 mRNA (including polyadenylation), tracrRNA/crRNA or chRNAs (without polyadenylation) are prepared by in vitro transcription from plasmid DNA, linearized at the end of the transcribed region with MluI (Cas9) or AlwI (RNAs), using the mMessage mMachine T7 Ultra kit and the MEGAclear kit (Life Technologies, Carlsbad, USA). Each of the RNAs was then diluted into injection buffer (10 mM Tris, 0.1 mM EDTA, pH7.2) to a working concentration of 20 ng/µl. The targeting oligodeoxynucleotides (Metabion, Martinsried, Germany) were in injection buffer and diluted to a working concentration of 30 ng/µl. Appropriate RNAs were mixed with the respective mutagenic oligodesoxynucleotide and stored at −80° C. One-cell embryos were obtained by mating of C57BL/6N males with super-ovulated FVB females (Charles River, Sulzbach, Germany). For super-ovulation three-week old FVB females are treated with 2.5 IU pregnant mares serum (PMS) 2 days before mating and with 2.5 IU Human chorionic gonadotropin (hCG) at the day of mating. Fertilised oocytes were isolated from the oviducts of plug positive females and microinjected in M2 medium (Sigma-Aldrich Inc Cat. No. M7167) following standard procedures (Nagy A, Gertsenstein M, Vintersten K, Behringer R., 2003. Manipulating the Mouse Embryo. Cold Spring Harbour, N.Y.: Cold Spring Harbour Laboratory Press). Embryos were injected with the mixture of the targeting ODN and the RNAs in a two-step procedure, as described (Meyer et al. (2010) *Proc Natl Acad Sci USA* 107:15022-6; Meyer et al. (2012) *Proc Natl Acad Sci USA* 109:9354-9359). Briefly, a first aliquot of the DNA/RNA mixture was injected into, whenever possible, the larger (male) pronucleus to deliver the DNA vector, as used for the production of transgenic mice. Upon the withdrawal of the injection needle from the pronucleus a second aliquot of the DNA/RNA mixture was injected into the cytoplasm to deliver the Cas9 mRNAs directly to the translation machinery. Injections were performed using a Leica micromanipulator and microscope and an Eppendorf FemtoJet injection device. Injected zygotes were transferred into pseudopregnant CD1 female mice and viable adult mice were obtained.

Genotyping of Founder Mice

Genomic DNA was isolated from tail tips of mice derived from microinjections, following the Wizard Genomic DNA Purification Kit (Promega) protocol. The obtained DNA pellet was dissolved in 100 µl 10 mM Tris-Cl, pH 8.5, incubated over night at room temperature and stored for further analysis at 4° C. To analyze founders for mutations in the Rab38 gene, exon was amplified using the PCR primer pair Rab-for (SEQ ID NO:10) (5'-GGCCTCCAGGATGCA-GACACC-3') and Rab-rev (SEQ ID NO:11) (5'-CCAG-CAATGTCCCAGAGCTGC-3'). Amplification was performed using Herculase II polymerase (Agilent Technologies) in 25 µl reactions with 30 cycles of 95° C.—20 s, 60° C.—15 s, 72° C.—15 s. Afterwards, the PCR products were directly digested with 10 U of SexAI and analyzed on agarose gels. Undigested products from positively identified founders were purified with the Qiaquick PCR purification Kit (Qiagen), cloned into pSC-B (Stratagene, La Jolla, USA) and sequenced. The results were compared to the genomic Rab38 sequences using the Vector NTI software (Invitrogen).

To analyze founders for mutations in the Fus gene, exon 15 was amplified using the PCR primer pair Fus-for (SEQ ID NO:12) and Fus-rev (SEQ ID NO:13). Amplification was performed using Herculase II polymerase (Agilent Technologies) in 25 µl reactions with 30 cycles of 95° C.—20 s, 60° C.—15 s, 72° C.—15 s. Afterwards, the PCR products were directly digested with 10 U of BccI and analyzed on agarose gels. Undigested products from positively identified founders were purified with the Qiaquick PCR purification Kit (Qiagen), cloned into pSC-B (Stratagene, La Jolla, USA) and sequenced. The results were compared to the genomic Fus sequences using the Vector NTI software (Invitrogen).

SEQUENCE LISTING (94 sequences)

SEQ ID NO: 1 - DNA, 144 bp, Artificial sequence
  /note="Description of artificial sequence: Oligodeoxynucleotide ODN-Rab38(G19V)"
cacctcacaaggagcacctgtacaagctgctggtgatcggcgacctggtagtgggcaagaccagcattattaaacggtacgtgcatcaaaatttctcctctcattatcgagccaccattggtgtggacttcgcgctgaaggtgc

SEQ ID NO: 2 - protein, 1411 aa, Artificial sequence
  /note="Description of artificial sequence: modified Cas9 protein"
MGPKKKRKVAAADYKDDDDKGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 3 - DNA, 9082 bp, Artificial sequence
  /note="Description of artificial sequence: plasmid pCAG-Cas9-bpA"
ggcgcgccggattcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgtcgcgccttcgccccgtgccccgctccgccgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagatccttaattaataatacgactcactataggggccgccaccatgggacctaagaaaaagaggaaggtggcggccgctgactacaaggatgacgacgataaaggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaagcgtcctgctgctactaagaaagctggtcaagctaagaaaaagaaatgaacgcgtaaatgattgcagatccactagttctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgagatccactagttctagcctcgaggctagagcggccgccactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatga

SEQ ID NO: 4 - DNA, 2834 bp, Artificial sequence
  /note="Description of artificial sequence: plasmid pT7-tracr-RNA"
  variation 553: /replace="a" /replace="c" /replace="g" /replace="t"
  variation 554: /replace="a" /replace="c" /replace="g" /replace="t"
  variation 555: /replace="a" /replace="c" /replace="g" /replace="t"
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagattaataatacgactcactatagggttggaaccattcaaaacagcatagcaagttaaaataaggctagtccgttatcaacttgaaaaagtggcaccgagtcggtgctttttttgatcagatccnnnatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 5 - DNA, 2848 bp, Artificial sequence
  /note="Description of artificial sequence: plasmid pT7-crRNA-Rab38"
  variation 567: /replace="a" /replace="c" /replace="g" /replace="t"
  variation 568: /replace="a" /replace="c" /replace="g" /replace="t"
  variation 569: /replace="a" /replace="c" /replace="g" /replace="t"
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagattaataatacgactcactataggggttttagagctatgctgttttgaatggtcccaaaaccctgtacaagctgctggtgatcggcgacctgttttagagctatgctgttttgaatggtcccaaaacgatcagatccnnnatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 6 - DNA, 2849 bp, Artificial sequence
  /note="Description of artificial sequence: plasmid pT7-chRNA-Rab38"
  variation 568: /replace="a" /replace="c" /replace="g" /replace="t"
  variation 569: /replace="a" /replace="c" /replace="g" /replace="t"
  variation 570: /replace="a" /replace="c" /replace="g" /replace="t"
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagattaataatacgactcactatagggctgctggtgatcggcgacctgttttagagctagaaatagcaagttaaaataaggctagtccgttatcaacttgaaaaagtggcaccgagtcggtgctttttttgatcagatccnnnatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 7 - DNA, 140 bp, Artificial sequence
  /note="Description of artificial sequence: Oligodeoxynucleotide ODN-Fus(R513G)"
tgggtagggtagttcagtaacacgtaatctaacataactttttctttcaggggcgagcacagacaggatggcagggagagaccatattagcctggctcctgaagttctggaactcttcctgtacccagtgttacccttgt

SEQ ID NO: 8 - DNA, 2848 bp, Artificial sequence
  /note="Description of artificial sequence: plasmid pT7-crRNA-Fus"
  variation 567: /replace="a" /replace="c" /replace="g" /replace="t"
  variation 568: /replace="a" /replace="c" /replace="g" /replace="t"
  variation 569: /replace="a" /replace="c" /replace="g" /replace="t"
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagattaataatacgactcactataggggttttagagctatgctgttttgaatggtcccaaaacaggggcgagcacagacaggatcgcagggaggttttagagctatgctgttttgaatggtcccaaaacgatcagatccnnnatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 9 - DNA, 2849 bp, Artificial sequence
  /note="Description of artificial sequence: plasmid pT7-chRNA-Fus"
  variation 568: /replace="a" /replace="c" /replace="g" /replace="t"
  variation 569: /replace="a" /replace="c" /replace="g" /replace="t"
  variation 570: /replace="a" /replace="c" /replace="g" /replace="t"
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagattaataatacgactcactatagggacagacaggatcgcagggaggttttagagctagaaatagcaagttaaaataaggctagtccgttatcaacttgaaaaagtggcaccgagtcggtgctttttttgatcagatccnnnatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 10 - DNA, 21 bp, Artificial sequence
  /note="Description of artificial sequence: primer Rab-for"
ggcctccaggatgcagacacc

SEQ ID NO: 11 - DNA, 21 bp, Artificial sequence
  /note="Description of artificial sequence: primer Rab-rev"
ccagcaatgtcccagagctgc

SEQ ID NO: 12 - DNA, 20 bp, Artificial sequence
  /note="Description of artificial sequence: primer Fus-for"
ctatggagatgatcgacgtg

SEQ ID NO: 13 - DNA, 22 bp, Artificial sequence
  /note="Description of artificial sequence: primer Fus-rev"
tggttacaattagggtagtctg

SEQ ID NO: 14 - protein, 1368 aa, Streptococcus pyogenes [sequence omitted]

SEQ ID NO: 15 - protein, 1368 aa, Artificial sequence
  /note="Description of artificial sequence: variant Cas9 (D10A)"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 16 - DNA, 36 bp, Artificial sequence
  /note="Description of artificial sequence: preferred DR sequence for use with the Streptococcus pyogenes Cas9 protein"
gttttagagctatgctgttttgaatggtcccaaaac

SEQ ID NO: 17 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 18 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 19 - protein, 1062 aa, Actinobacillus succinogenes
MNLNYILGLDLGIASVGWAVVEIDEQENPQRLIDVGVRTFDRAEVLKTGESLALARRLARSSRRLVKRRAERIKKAKRLLKAENLLLSADEILPNEAWQLRVKGLDQKLERQEWAAVLLHLLKHRGYLSQRKNESKSENKELGALLSGVAINHQILQSAEYRTPAEIAVNKFQAEEGHIRNQRGAYTHTFSRLDLLAEMELLFQRQATLGNPHTSTKLLENLTALLMWQKPALAGEAILKMLGKCTFEPTEYKAAKNSYSAERFVWLTKLNNLRILEQGAERALTDNERFALLDQPYEKAKLTYAQVRTLLGLSDEAIFKGLRYQGEDKKAVETKTTLMEVKAYHQIRKALEGLDLKAEWNELKNNPALLDEIGTAFSLYKTDDDIHRYLDGKLSESVLNALLENLNFDKFIQLSLKALQQILPLMLQGQRYDEAVSAIYGDHYGKKSDEIDRLLPNIPTDEIRNPVVLRTLTQARKVINAVVRLYGSPARIHIETGREVGKSYQDRKKLEKQQEENRKQRENAVKKFKEYFPNFVGEPKGKDILKMRLYELQQAKCLYSGKSLELYRLLEKGYVEVDHALPFSRTWDDSFNNKVLVLANENQNKGNATPYEWLDGKNNSEGWQHFVARVQTSGFSYAKKQRVLIQELDEKSFIERNLNDTRYVARFLCNHIADNMLLTGKGKRKVFASNGQITALLRGCWGLQKVRENNDRHHALDAVVVACSTKSMQDKITKFVKYKEGRLFKDKKDGVYKGERINRETGEIISLHFPTPWKFFKENVEIRIFSENPKLELENRLPDYPQYNHEFVQPLFVSRMPTRKMTGQGHMETVKSAKRLDKGLSVLKVPLTQLKLSDLERMVNREREMALYEALKECLEQFGNDPAKAFAEPFYKKGGALVKAVRVEQTQKSGVLVRNGNGVADNATGSIVRVDVFTKGGKYFLVPIYTWQVAKGILPNKAVIQGKDESEWEEMDENAVFQFSMHKNDLIKVKTKKGEIFGYFNGLDRATGSIEIEEHDLEKSKGKNGSHRGLGVKTAFFLEKYQVDELGKNIRPCRPTKRQHVR

SEQ ID NO: 20 - protein, 1064 aa, Bradyrhizobium sp. BTAi1
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 21 - protein, 1436 aa, Bacteroides fragilis 9343
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 22 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 23 - protein, 984 aa, Campylobacter jejuni 11168
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 24 - protein, 1426 aa, Capnocytophaga ochracea
MKNILGLDLGTTSIGFAHIVEDENKEKSEIKELGVRIVSLTTDEQSDFEKGKSITTNANRTLKHGARLNLDRYQQRRKYLIDLLQKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTTENKGSKESVRLQAYQWRAEAISKQLSKEEVAYVLTEINNNLNNASGYLGAISDRSKELYFNRQTVGQYLYAKLQENRHNSLKNKVFYRQDYLDEFERIWETQASFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIREKVKAIFQTLGICTKILYFDPLLPVKEFEEQDSYQLWHLLYSYESDDSTSGNETLYRILEKKYAFKREHARILANVALQDDYGSLSTKAIRKIYPNIKENQYSTACEKAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKEFGIKNPTKSDIIRYRLYQELEHNGYKELYTNAPIARDMLFSKNIEIEHIVPKARVFDDSFSNKTLTFHRINSDKGEYTAFDYITSLNSEEELNQYLTRVENAYKTKSISPTKYKNLLKKASEIGDDFINRDLRDTQYIAKKAKEILFQVTKNVLSTSGSITDRLREDWGLVDVMKELNMPKYQSLGLTEVEERKDGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNTNKPAGTDKQQITLTPRGQLHKETIYGKYQYYINKEEKIGVKFDERTIAKVSNPVYREALLKRLQANDNDPKKAFAGKNALSKNPIYLDESKTKTLPEKVNLTYLEEDFSIRKDISPDNFKDLKSIEKVIDQGVKRILIKRLQAYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFDAVVRAQQGIPIIDKTYKQAEGWQFLFTMKQNEMFVFPNATTGFNPAEIDLLDPKNKKLISPNLFRVQKIATKDYFFRHHLETNVETDNILKNVTWKREGLSGLKDIVKVRINHLGDIVSIGEY

SEQ ID NO: 25 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 26 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 27 - protein, 1131 aa, Diaphorobacter sp. TPSY
MAQHVFGLDIGIASVGWAILGEQRIIDLGVRCFDKAETAKEGDPLNLTRRQARLLRRRLYRRAWRLTQLSRLLKRKGLIADAKLFAKAPSYGDSAWELRRQGLDRLLTPLEWARVIYHQCKHRGFHWTSKAEEAKADSDAEGGRVKQGLAHTKALMQAKNYRSAAEMVLAEFPDAQRNKRGQYDKALSRVLLGEELALLFATQRRLGNPHASDFFEKLILGDGDRKSGLFWQQKPALSGADLLKMLGKCTFEKGEYRAPKASFSVERHVWLTRLNNLRIVVDGRSRPLNEAERQAALLLPYQTETSKYKTLKNAFIKAGLWGDGVRFGGLAYPSQAQIDAEKTKDPEDQFLVKLPAWHELRKAFKAAGHEALWQQISTPALDGDPTLLDQIATVLSVYKDGAEVVQQLRQLALPEPAASIAVLEKISFDKFSSLSLKALRRIVPLMQSGLRYDEAVAQIPEYGHHSQRIEPGAAKHLYLPPFYEAQRKYAGKGDHIGSMQFRDDADIPRNPVVLRALNQARKVVNALIREYGSPIAVNIEMARDLSRPLDERNKVKRAQEEFRDRNDRARSEFERDFGYKPKAAAFEKWMLYREQLGQCAYSQQPLDIQRVLDDHNYAQVDHALPYSRSYDDSKNNKVLVLTHENQNKGNRTAFEYLTSFPDGEDGERWRTFVAWVQGNKAYRMAKRNRLLRKNYGVDESKGFIDRNLNDTRYICKFFKNYVEEHLQLAARADGDTARRCVVVNGQLTAFLRARWGLTKVRGDSDRHHALDAAVVAACTHGMVKALADYSRRKEISFLQEGFPDPETGEILNPAAFDRARQHFPEPWTHFAHELKARLFTDDLAALREDMQRLGSYTTEDLGRLRTLFVSRAPQRRSGGAVHKETIYAQPESLKQQGGVIEKILLTSLKLQDFDKLLNPESNDHFVEPHRNERLYAAIRQRLEQFGGRADKAFGPDNLFHKPDKNNQPTGPVVRSIKLVRGKQTGIPIRGGLAKNDSMLRVDIFTKAGKFHLVPVYVHHRVTGLPNRAIVAFKDEDEWTLIDESFAFLFSVYPNDYVKVTLKKEQQSGYYSGADRSTGAMNLWAHDRAASVGKDGLIRGIGVKTALSVEKFNVDVLGRIYLAPPETRSGLA

SEQ ID NO: 28 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 29 - protein, 1114 aa, Eubacterium rectal
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 30 - protein, 1512 aa, Fibrobacter succinogenes
MKKILGLDLGTNSIGWAVVNADEITRDDGSRYLKPNGISAAGSRIIPMSADILGDFEKGNSISQTAERTRMRMARRLHERALLRRERLLRVLNLLDFLPKHFADKIDRYGKFTDDSEPKLAWRKNTEGKYEFIFQDAFNEMLAEFKDKQPEIVEEGKKIPYDWTIYYLRKKALEKALSKEELSWILLQFNQKRGYYQLRGEEEEIPQDKKIEYLAQKVVKVEATDQKKGDDVWYNVYLENGMIYRRTSKAPLDWEGKVKEFIVTTEVENDGETPKKDKEGNIKRSFRAPKEDDWTLLKKKTEADIENSHKTVGCYIYDSLLNNPKQKIIGKLVRTVERKFYKEELTQILKKQVELIPELRDDNLYKQCIEELYPINEAHRNTIAKTDFANLFINDILFYQRPLKSKKSQIDNCPYEERIFIDSKTGEKKKVPVKCIAKSNPLFQEFRLWQFIQNLRIYQREKEIDGKLLTDIDITSECLKSEEDYVRLFDWLNDRETIEQEDLLKHLFNTKKSKNKENPYRWNYVEDKVYPCNETRATILKGFSKCGINASVLSPELEMALWHILYSVEDKKEIETALTHFAQKQGWNDDFAKVFSKAKPFKKDYGSYSEKAIKKLLSLMRMGKYWNQDNIDKNTLDRIDKIINGEYDEKISNRVRDNAINLKDISDFRGLPVWLACYIVYDRHSEAKDCTKWNSPEEIDSYLKKFKQHSLRNPIVEQVVTETLRTVRDIWIQEEQIDEIHLELGRDLKNPADKRKKMSENILKNENTNLRIKAMLMEFMNPSMGIENVRPYSPSQQDILRIYEENALDNLTKDDKDFDFISKISKQAQPSKTDIIRYKCWLEQKYRSPYTGKTISLSKLFTPAYEIEHVIPQSLYFDDSFSNKVICEAEVNKLKDRQLGYKFIAEHHGEKVQLSQGEVVEILSVDAYEKFVKENYANNRIKMKKLLMESIPDEFIERQLNDSRYISKVVKGLLSNIVREKIDDENYEPEAVSKNLISCNGAITDRLKKDWGMNDVWNSIILPRFIRMNQITGKDCFTTTNAEGHLIPQMPLELQKGFNKKRIDHRHHAMDAIVIACTTRDHVNLLNNEAAHSKFNATRYQLQRKLRRFEKAVIDGKEREVAKEFLKPWDSFSSDSKNILENIIVSFKQNQRVINKTTNAFLHFDENGKKTFIKQGKGDSWAIRKSMHKDTVFGEINLRKVRSVSLNEAIKVPERVLNKKIKEKILELKNNKIDAKNIKKYIEENHTGGYGIDSSKIDVFYFTKETKERFFATRKTLDTSFNQAKIKDSIADSGIQKILLAHLKSKNGDAEQAFSPDGIDEMNKNIVELNNGKFHQPILKVRVYEKADKFAVGQKGNKKVKFVEAAKGTNLFFAIFEKDGKRSYLTIPLNVMIDCQKQYGNQWKNNIEAYLKEKELVEKDVKLQFILSPNDLVYLPTEGSIDKKRIYKVVSFTNNRLYAIPYAIAKSIVDKNEFTQLNKIEFTDNKESIKDACVPVIIDRLGNVIEFNGKRL

SEQ ID NO: 31 - protein, 1347 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 32 - protein, 1354 aa, Flavobacterium psychrophilum
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTSIYKAFEKILEVEGYEIDFSKMKPLEIKETVAPIFETLNINTVILDFDPTIQGNDFDKQPYYQLWHLLYSAEDDDKLKETLKTKFGFKENHLPFILNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKASDLFSKNYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLRQDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLGLSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 33 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 34 - protein, 1050 aa, Gluconacetobacter diazotrophicus
MGENMIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALTISAHNDPKSIHSGIGTKTLLAISKYQVDRFGRKSPVRKEVRTWHGEACISPTPPG

SEQ ID NO: 35 - protein, 131 aa, Helicobacter hepaticus
MRILGFDIGITSIGWAYVESNELKDCGVRIFTKAENPKNGDSLAAPRREARGARRRLARRKARLNAIKRLLCKEFELNLNDYLANDGELPKAYQTSKDTKSPYELYTAFHWIIFAFCSIASSLSNRQMLPI

SEQ ID NO: 36 - protein, 1361 aa, Lactobacillus casei BL23
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 37 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 38 - protein, 1149 aa, Lactobacillus salivarius
MERYHIGLDIGTSSIGWAVIGDDFKIKRKKGKNLIGVRLFKEGDTAAERRGFRTQRRRLNRRKWRLKLLEEIFDPYMAEVDKYFFARLKESNLSPKDSNKKYLGSLLFPDISDSNFYDKYPTIYHLRRDLMEKDKKFDLREIYLAIHHIVKYRGNFLEKVPAKNYKNSGASIGFLLEEVNDLYGNIIGNEDVAILDNDKFEDVEKIILNDEIRNIDKQKNVGRLLVKDKKEKNIVTAFSKAIFGYKFNLEDLLLIESDEKNKLTFNDENIDDIFNELSHSLNDNQMDLLTKTREIYFKFKLNMIVPTGYTISESMIEKYEMHKAHLKMYKEFINTLNAKDRKILKNAYSDYINNEKAKAANAQENFYKTVKKTIKENDSDTAKKIIGLIDEGNFMPKQRTGENGVIPHQLHQIELDRIIENQAKYYPWLAEENPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKYKVLNELNNIKVNKKKLDVEQKQHVYLDLFTTRKNVTKDDLATSLNCDVESITGLTDNKKFNSSLSSYIDLKAILGNIVDDYSKNEDLEKIIEYSTIFEDGNIYKEKLSEISWLTDEQIEKLSNIHFKGWGRLSKKLLTQITNENGERIIDTLWNTSNNFIQVISDESIQAKLAEINGEYANKYNLEDILDEAYTSPQNKKAIRQVMKVVEDIEKAMKCEPTSIAIEFTREKRKSKLTNTRYKKISETYEKITDELISEYELGKLQSELDSKVNNMRDRYYLYFMQLGRDMYTGEKMNIDELHQKYDIDHILPQSFIKDDSLNNRVLTSKSVNIKEKSDKTAADLYAAKMGDFWRKLRKQGLMTEQKYKNLLTRTDSINKYTKQSFIKRQLVETSQVVKLAANILQDKYRNTKIIEIRARLNSDLRKKYELIKNREVNDYHHAIDGYLTTFVGQYLYKVYPKLRSYFVYDDFKKLDSNYLKHMDKFNFIWKLEDKKAEDVYDKVNDEFVLNVPEMKEYIRKIYNYKYMLVSKEVTTKNGAFYDQTKYNAKTINLIPIKKDKPTNIYGGYKGKVSSYMMLVKIQKKKEVIYKFVGVPRLWTDELDRLIDTDEKKALLKK

SEQ ID NO: 39 - protein, 1368 aa, Streptococcus pyogenes MGAS6180
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 40 - protein, 1368 aa, Streptococcus
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 41 - protein, 1371 aa, Streptococcus
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGSD

SEQ ID NO: 42 - protein, 1368 aa, Streptococcus pyogenes MGAS2096
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 43 - protein, 1368 aa, Streptococcus pyogenes MGAS9429
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 44 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 45 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 46 - protein, 641 aa, Nitrobacter hamburgensis
MHKRNSRSYRLGLDLGSNSLGWFVTHLEKRGDRYEPVALDPGGVRIFPDGRDPQSGMSNAVDRRMARGARKRRDRFVDPYALRKAALTNALPAHRVGRAIFHLNQRRGFQSNRKTDRKQSEDGAIKQAASKLKARMHEEAAPTLGAFFADMHLRKSYDDQQTAIRAELVRLGKDHLTGNARKKVWAKVRKRLFGDEVLRPKDTSDGARARATTTGTKASYDFYPTRAMLLDEFNAIWAAQREHHLAMTDEAKAEIEHIIFYHRPLKPAIVGKCTLDPATRPFKEDPEGYRAPWSHPLAQRFRILSEARNLEIRETGKTSRRLTKDQSDLVVAALLANREVKFDKLRTLLKLPAEARFNLESDRRSTATRPPHGCRTRRASIRRGAGFLRNGRSRSSPDWKKPKTKTNCSHGSKWNAHLTAQRPRASPIRRCRTAIAGSACAQSKRSCRSCRTSSMRMALRAPAITSWPSVPATTIPVDTFQQGGNAFGRILSVVTIELFAITDRVDPVQEQDARCFALRIAECRSDGLQHFAEVSLGLPPRNAAQDQRHSAGLCQSSCVGRFVPGTPCRRTPRSTSLHGKEPSAHAFGSTARSRPQLPASPRPCMSFRDGTSSSPARMPETLDRCAISRSNRSSVCRAERL

SEQ ID NO: 47 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 48 - protein, 1082 aa, Neisseria meningitidis Z2491
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 49 - protein, 1082 aa, Neisseria meningitidis
MAAFKPNPINYILGLDIGIASVGWAMVEIDEEENPIRLIDLGVRVFERAEVPKTGDSLAMVRRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHISGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 50 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 51 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 52 - protein, 1066 aa, Rhodopseudomonas palustris BisB18
MSERVVRRILGIDLGIASCGWGVVDISGAGGGIIATGVRCFDAPLIDKTGEPKSATRRTARGQRRIVRRRRQRMNGVRRLLCEFGLLPDPRPDALNQAMRRISTASAAAQVTPWTLRAAAHQRLLSNEELAVVLGHIARHRGFRSNAKNEAGANAADETSKMKKAMEATREGLAKYHAFGDMIANDPKFANRKRNRDKDYSHTAKRSDLEDEVRAILRAQLRFGSAAATETLAQTFADVAFFQRPLQDSEDRVGDCPFEPGQKRAARRAPSFELFRFLSRLANLKLAVGRSPERRLTAEEIALAAKGFGETKKTITFKSLREALDLDPNARFSGIGKDKEASLDVVARTGGAAYGTKTLKDALGDAPWRSLSRTPETLDRIAEILSFREDITSIRNGLEDLGLDSLVVEALMQAAANGDFKEFTRAGHISARAARNIIPGLREGLVYSEACARVGYDHAARLSVPLDQVGSPVTRKALSEALKQVRAVAREYGPIDYFHIELARSVGKSAEERKQLTDGIEARNVEKAKRRKQAEEHLGRAPSDDELLRYELAKEQNFKCIYSGDAIDPAGVAANDTRYQVDHILPWSRFGDDSYLNKTLCTARSNQNKRGRTPFEWFEADKTDVEWMEYVARVENLQEVKGRKKRNYSIKDAAAIEDKFKARNLTDTQWATRLLADELSRMFPPRECERAICGRADGGNDGLTIVEERRVFTRPGAITSKLRRAWGLEGLKKQDGKRVEDDRHHAVDALVLAATTESLLQRLTVEVQRREREGRPDDIFHCAEPWRGFRADVRRTVYGSETMPGIFVSRAERRRARGKAHDATIKQIREIEGERLVFERKPVEKLTDKDLEKIPIPKPYGQVSDPKRLRDELVESLRAWIAAGKPKDRPPLSPKGDVIRKVRIQTNDKVSVEINGGTVDRGDMARVDVFRKKNKKAVWEYYVVPIYPHQIVALNDPPDRAVIAYAEDKDWKEIDSSYEFLWSLFGLSYVEISKANGECIDGYFRGLHRGTGAASVCKHISLGKDATVSGIGLKTLASFKKFTIDRLGRKFEIPREVRTWRGEACT

SEQ ID NO: 53 - protein, 1064 aa, Rhodopseudomonas palustris BisB5
MSECVTRRILGIDLGIASCGWGVIEVGEASGSIIASGVRCFDAPLIDKTGEPKSATRRTARGQRRIIRRRRQRMNAVRRLLAEFGVLTGRSPDALHQALLRLSQSVAGSQVTPWTLRAAAHERKLTNDELAVVLGHIARHRGFRSNSKNDGGANAADETSKMKKAMETTREGLARYHSFGAMIASDPKFADRKRNRDKDYSHTAKRSDLEDEVRTIFRSQTRFGSLVASEKLSQAFADAAFFQRPLQDSEDMVGSCPFEPGQKRTARRAPSFELFRFLSRLANLKLTVGRAPERRLTPDEIALAAKGFGETKKSITFKSLREALDLDPNARFSGVAKEKESTLDVAARTGGAAYGTKTLKDALGDAPWRSLSRMPEKLDRIAEILSFREDMKAIRNGLEEVGLDGLVVDALMQATANGDFKDFTRAAHISALAARNIIPGLREGLVYSDACTRVGYDHAARPAVPLSQIGSPVTRKALSEALKQVRAVAREYGPIDYFHIELARSIGKSAEERKKLTDGIEARNVEKEKRRKEAAEHLGRAPSDDELLRYELAKEQNFKCIYSGDPIDPAGISANDTRYQVDHILPWSRFGDDSYVNKTLCTARSNQNKRGRTPFEWFDADKTEAEWMEYSARVEDLKEVKGRKKRNYSIKDAASVEDKFKARNLTDTQWATRLLADELKRMFPPRECERVVTVRADGGNDGLSIVEERRVFTRPGAITSKLRRAWGLEGLKKQDGKRVEDDRHHAVDALVLAATTESLLNRLTVEVQQREREGRQDDIFHCSQPWPGFRVDVQRTVYGSETMPGIFVSRAERRRARGKAHDATVKQIRDIDGERIVFERKPIEKLTDKDLERIPVPEPYGKAADPKKLRDELVENLRAWIAAGKPKDKPPRSPKGDIIRKVRIETKDKVAVEINGGTVDRGDMARVDVFRKKNKKGVWEFYVIPIYPHQIVASALPPNRAVIAYKAESEWTAIDGCFEFAWSLNPMSYLELVKSNGELIEGYFRSMDRTTGAINLSPMSTNSETIRSIGVKTLSSFRKFTVDRLGRKFEIPREVRTWRGEACT

SEQ ID NO: 54 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 55 - protein, 1370 aa, Streptococcus agalactiae 2603V/R
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 56 - protein, 1370 aa, Streptococcus agalactiae A909; identical to SEQ ID NO: 55

SEQ ID NO: 57 - protein, 1259 aa, Streptobacillus moniliformis
MKYILGLDLGVASIGWAVTEINEKGEPVGLIDANSVIFKPLDNDKGKLYNVERRDKRGSRRILRRKKHRVERTKMLLVNSSFLTNEEIDNLYVGKLDNIYEVRLKGLKEQLSKNEIARLMIYYCKNRGFKSNRKTEDLEILKSLGEKISEKDSDEKKLKPIIAKNTELIESKGLTPIEVIYMIRENDNSILGFKNKEGNYKFGFKRNQVIDEVRKILGTQQILSKEIVDEYIDILSSQRDFSDGPGGDSKYKIDYTKLAGKCKYTGEVRAVKSAPSYEIFTMLQKLNDIRYVKFTSEDKIEKKKLSKEVIHKLYDLVVEKNKTLTYDLIEKSIDEENIKLLNIPKLSKSKYVELRKSYFKERNDNENLTEEEINAFNEKLNNERMKQELIRNNLKAYKELKSKFKKNNIDENRIKELGGIYFLDLVAELLTYSKTDEKLEYFVENVERYSLFKEQRDIVEIIKTFPNYTKNGNLSLSLVRELNKLLMEGHDYESSLSSLNYYIDTDVDWEKFPTISEIEDSLSTKITNPNVKHILVILRKLYNTLLFKYGRPEKVHLELSRDFSNDFSTRNKIQKEQLENKVRREVAAFEMYGANKDIVAGKDRLSNDDFVRIKLWEEQNKVCMYSGRTIEKYQLTSAEVQIDHILPYSKSFDNSYSNKVLVFSNENQDKKERTPYQWLKGTEKWNEFKQRVRLNLNISNKKKENLLFEDEVVNNEFLERELHATSYSSRLALNIFQRLIPVSDEDKYDEHGNEKVKYLYNRNVIAFQGKMTSMLRNLYSLNKYTHSFESDTLDIDNKAFILKEFEINKDNLKMTAYNVNTGLEITSETKVEKNKSGEFKTIKDELLKKELDKKENLIEISDYFKDKVLFDLKIVDFEEIDTVEPEIISILYKMITALKEEVYSKNRENHLHHSLDAFLLTIMNRSMQMKLIKYNQLISVLKNKEIEIFNEEKGEYIDSKEFAEELQKQKIIDIDGNERGIKFNVNGKTHRLNLVKPYENFLDDIKNKIFDKRENNKLPYHVVKSKVSGALHAETILGESKGEITKRISVFDINYKNLGKIFDKDGSQKEIYETLVKWLEAKSKDYPKLKNGNIIKKVKIVDGNKDKLIKLGNKRYVEMGRTTVKILVLKKEAEEGLKFASIGRYKYNLLKSEKDVNISIWKDAIHFCKVRYNKLKENGYRLIHELIPGETIELELNKGNISKCLVVGFSGGKIEISSVIGDALDLINDKISTRIKERYYITVSTIKSIKKINKNILGD

SEQ ID NO: 58 - protein, 1344 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 59 - protein, 1368 aa, Streptococcus pyogenes SSI1
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 60 - protein, 1368 aa, Streptococcus pyogenes NZ131
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 61 - protein, 1368 aa, Streptococcus pyogenes M1GAS [sequence omitted]

SEQ ID NO: 62 - protein, 1368 aa, Streptococcus pyogenes MGAS5005
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 63 - protein, 1121 aa, Streptococcus thermophilus LMD9
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 64 - protein, 1388 aa, Streptococcus thermophilus LMD9
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 65 - protein, 1128 aa, Streptococcus thermophilus Z1066
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKRLRLQIKQNISNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 66 - protein, 1122 aa, Streptococcus thermophilus 18311
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 67 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 68 - protein, 1032 aa, Artificial sequence
  /note="Description of artificial sequence: TGRD_056 (Csn1-like CRISPR-associated protein) of Uncultered bacterium TG1RsD17"
MLYHIANHRGTDSVRSFLEYDDDKIKENTLTAKIAKETKKVIDAKKYRTFGEYLYKGKIEKFQQNIRKKVSNRKTPANKNKEFAVTRDVIIKETEKILASQKQYYTYILTDEYIKKIKDAISYQTEKLIPESGYCPYFKDEKRLPRSHKLNEYRRMYEALNNAKYFDPVLDENTGEILSYQEKEFSREEKKILFDEVLLKGMELTESGAKKLLYHLPDGCEVQLQGRDKTTQKIKGYALVDLEASPFWLRLSQQQQDEFLYDWNSLPLEKLKPKLTNYYSLTESEVDETFQEIKLPSNYASVGKKAMEILLTYIKDGCSYTEALEKAVSEGKLKVDKQTMIYDSLPYYGKILKESTQKLIGKAFSKQFADRNYKEPDTNKNEREFGKIANPVVHQTLNELRKLINEIITVFGKKPLEIGLETTRELKKSKKNREYLSKQQNKNEYARNRIYKEYIEPHLSQIKSRQENPSKYISKFELLEEQNFICPFCSEKITPDDIINSKVDVEHIFPIEESEDITKNNLVIAHNECNADKGKKSPFDAFGDKTSGKYRWNCILHNAQKNLPHKVWRFYQGSLEKFLENKPMSRRFGTDNSYISKIAARYLACLFNDPYHSEIFCIKSSLIAQLRIAWDLNSIMVPLVKNILSEKELEEFKISKNKKIRIDNRHHALDAIVIAYANRGYHNFLNRIHAKEYKINYREKSWLSKILLPPLNRDLEDFKISVKDSIEKANVSIKHDHNTNGSLVKATAYKVYYSGAGEYIITTSKNVEEISFKEKEDPKDTLYRALCKFECRDIDIKDEKLIKKLKYNSTLYKKVQNNLSKAKQELEQDNKKTEEEGKKSQKITEVRIYKKACSLVKGQYIQCGSRLKDKFFAVKEPTEIKTGLGYDTGDNLFLDLYYDKTGKLCGEIIRKVNFNRNKPNYQKEGYTLFERIYQSDILEVDTSEDRISLKNKTGSAPSDRTFIKVNTFTEVNAYFDGKRDKIQIFFGNLLKSSFKNDSFFISSMQKYNVRKVILTSLGIIKYRSQILKNKEV

SEQ ID NO: 69 - protein, 1032 aa, Artificial sequence
  /note="Description of artificial sequence: TGRD_222 (CRISPR-associated protein Csn1) of Uncultered bacterium TG1RsD17"
MKKRILGLDIGIASVGWALVEFDDEFQDNKKKGTIIKSGVRIFTRAETPKERESLAKPRREARSQRRRIRRRVERLNSIRELFVKNGVVEEWSVSKKNPNNIYITLNQIKTPWQLRMESLDRKLTNEQFAVVLTHLAKHRGYKSLRKDDKAGKVLEAISQNKKRLNDSDYRTLGEMFCKNESYKEHKRNKGGEYINSVARELIEEEVEKIFVKQREKGNNFADVNTEREYLKIAFSQKPAGSISKMVGFCTFENGEKRAPRDSYSAELFKVLCTINNTTFTDMKTGEIRSFSKEEIGKTLETVKNVKDVKYAKIRKDLGLEDSVKFSGVDYRENAKSKGEGEIFVSMKTYHEIKSKIEKLSKEKWDNLKGNTELLDSIVNIIANLKDDESIKKEFQKLKIDEDIIDVLLNFEFKKFINLSFKALRKIIPFQFQGQKYITASTSAGYSLKQEGIKNKLVPPAKENINVAVVARAFAQTRKVINAVIRKYGQFDQINIELATELKNSKFDRSKIEEGQKKFQSQKDKIFKEVQELRGGMTPSSSLLLKYRLWREQDERCVYSGRKISFEDLLDTGFLDIDHIIPYSKSMDDSFNNKVLCLAEENRNKKNDIPFNYYQRIDRDWNLLISIITSMKNMKIAKKSRLLKQELSDIEGFIERNINDTRYATRYIKDFLENNLEFKENEFIKVKVQARSGGLTSVLSYNWGMSKDREESYFHHAKDAIIVACSTQGMVQYISKISQQYENDKDKMKKIKDKTENCIPKPWDSFRADVEESIEGIFVSFAPRHKVTGSAHKETIYSKKHLEKERYVTVKKSLDKIKLSDLENIPCNENCGIIRVLKERLEKFKNDSLKAFADPVHMPTKCPNKKGPVIRSVKIKESNKTGIEVRKGLAERGEMVRVDVFIKDKKYYLVPIYVSDFKNKDLPNKAIAALKLENEWIMIDKTYSFKFSLFKDDLIKIKKKKEEIFGYFGGVHRSTGTIKIKSRHKPKEIDEGIGSRCLLDFRKFQVDVLGNYTEVKHEKRMPAYITRKDKKH

SEQ ID NO: 70 - protein, 1067 aa, Verminephrobacter eiseniae
MNKAVAYRLALDLGSTSLGWAIFRLNEAREPTAIIRAGVRIFSDGRNANSEPLAVHRRVARAMRRRRDRLLKRKKRMHDQLVQHGFFPAEVAERKELERLNPYQLRAKGLHEALTPGEFARALFHINQRRGFKSNRKTDRKDNDSGALKQAISELRKRIQDSDCATAGEWFWKERMQQKPEGVRGQWVRARYRKTPSTTDEGKKRIGYDLYVDRAMVEQEFDALWAAQAALQPGLFTEAARAELKDTLLYQRDLRPVKPGRCTLLPAEERAPLALPSTQRFRILQEVNNLRLLDEALREVPLNLAQRDAVVSALEGKKELSFAAIRKLLTLSGKFNLEDEKRAELKGNATSVILARKDLFGDAWAGFDAAVQDEIVWRLVSQESEGALIAWLQQHTGVDGVCAEAIVNTRLPDGYGRLSRKALERIVPALQREVCTYDKAVQAAGFAHHSDLGFDFDYAEDEVQQVGEHTIASTGEVQAQYAFKQLPYYGKALQRHVAFGSGDAKDHEEKCYGKIANPTVHIGLNQVRTVVNALIRRYGHPTEVVVELARDLKQSREQKQQTQREQADNQKRNEDIRKRIAPILETSPERVRDRDIKKWILWEELNKKDIADRHCPYSGERISATMLLSEAVEIEHILPFSRTLDDSLNNRTVAMRRANRIKGDRTPWEARADFEAQGWRYEAILQRAEGMPPRKRYRFAEDGYQRWLGKDRNFLARALNDTSYLSRLAANYLRLVCPQGVRVIPGQMTDKLRGKFGLNSVLGLDGKKNRNDHRHHAVDACVIGVTDQGLMQRFANASKQARENGLTRLVQDMLLPWWPSYYDHVERAVRIRVSHRPDHGFEGAMMKGTAHGIREDGIREDGRIKQRPKAKGSADHKTITLIPIDEPRQLARHGVDAEGKPLPYKGYASGSNYCIEITKNGKGKWEGQVISTFDAYRIKAAADAAARAGQVISTVEADSIVRKSGWERLRGAQSQNGQPLVMRLVIGDSVRMEVDGRDEVMRVVKMSGKEMVFAPVREANVDKRNNMPDEQDPFTYTYKRADQLRKAKARQVTISPIGELRDPGFKG

SEQ ID NO: 71 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 72 - protein, 1368 aa, unknown; identical to SEQ ID NO: 59
  Cas9 protein of unknown microbial species

SEQ ID NO: 73 - protein, 1187 aa, unknown
  Cas9 protein of unknown microbial species
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 74 - protein, 1274 aa, unknown
  Cas9 protein of unknown microbial species
MNINMNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 75 - protein, 984 aa, unknown
  Cas9 protein of unknown microbial species
MAKILAFDIGISSIGWAFSENDELKDCGVRIFTKAENPKTGESLALPRRIARSARKRLARRKARLNHLKHLIANEFKLNYEDYQSFDEILAKAYKGSLISPYELRFRALNELLSKQDFARVILHIAKRRGYDDIKNNGDEEKGKILKAIKQNEEKLANYQSVGEYLYKEYFQKFKENSKEFINVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTLYTKDDLNALLNEVLKNGTLTYKQTKKLLGLSDDYEFKGEKGNYFIEFKKYKEFIKALGEHSLSQDDLNEIAKDITLIKDEIKLKKALAKYDLNENQIDNLSKLEFKDHLNISFKALKLITPLMLEGKKYDEACNELTLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNTAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREEFKNELR

SEQ ID NO: 76 - protein, 1082 aa, unknown
  Cas9 protein of unknown microbial species
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPAEPKAAKNTYTAERFIWLTKLNNLRILEQGSERPLTDTERTTLIDEPYRKSKLTYAQARKLLELDNTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIDLPPIPADEIRNPVVLRALSQARKVINGVVRRYGSPARIHIETAREVGKSFKDRKEIEKRQEENRKDREKAATKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 77 - protein, 984 aa, unknown
  Cas9 protein of unknown microbial species
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 78 - protein, 1136 aa, unknown
  Cas9 protein of unknown microbial species
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 79 - protein, 1371 aa
  Cas9 protein of unknown microbial species
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 80 - protein, 1348 aa, unknown
  Cas9 protein of unknown microbial species
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 81 - protein, 1363 aa, unknown
  Cas9 protein of unknown microbial species
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 82 - DNA, 88 bp, artificial
  tracr RNA
ttggaaccattcaaaacagcatagcaagttaaaataaggctagtccgttatcaacttgaaaaagtggcaccgagtcggtgcttttttt

SEQ ID NO: 83 - DNA, 102 bp, artificial
  crRNA-Rab38
gttttagagctatgctgttttgaatggtcccaaaaccctgtacaagctgctggtgatcggcgacctgttttagagctatgctgttttgaatggtcccaaaac

SEQ ID NO: 84 - DNA, 102 bp, artificial
  crRNA-Fus
gttttagagctatgctgttttgaatggtcccaaaacaggggcgagcacagacaggatcgcagggaggttttagagctatgctgttttgaatggtcccaaaac

SEQ ID NO: 85 - DNA, 103 bp, artificial
  chRNA-Rab38
ctgctggtgatcggcgacctgttttagagctagaaatagcaagttaaaataaggctagtccgttatcaacttgaaaaagtggcaccgagtcggtgcttttttt

SEQ ID NO: 86 - DNA, 103 bp, artificial
  chRNA-Fus
acagacaggatcgcagggaggttttagagctagaaatagcaagttaaaataaggctagtccgttatcaacttgaaaaagtggcaccgagtcggtgcttttttt

SEQ ID NO: 87 - DNA, 69 bp, artificial
  Rab38 Exon 1
atgcagacacctcacaaggagcacctgtacaagctgctggtgatcggcgacctgggtgtgggcaagacc

SEQ ID NO: 88 - protein, 23 aa, artificial
  Rab38 Exon 1
MQTPHKEHLYKLLVIGDLGVGKT

SEQ ID NO: 89 - DNA, 69 bp, artificial
  ODN-Rab38 (G19V)
atgcagacacctcacaaggagcacctgtacaagctgctggtgatcggcgacctggtagtgggcaagacc

SEQ ID NO: 90 - protein, 23 aa, artificial
  ODN-Rab38 (G19V)
MQTPHKEHLYKLLVIGDLVVGKT

SEQ ID NO: 91 - DNA, 40 bp, artificial
  Fus Exon15
gggcgagcacagacaggatcgcagggagagaccatattag

SEQ ID NO: 92 - protein, 12 aa, artificial
  Fus Exon15
GEHRQDRRERPY

SEQ ID NO: 93 - DNA, 40 bp, artificial
  ODN-Fus (R513G)
gggcgagcacagacaggatggcagggagagaccatattag

SEQ ID NO: 94 - protein, 12 aa, artificial
  ODN-Fus (R513G)
GEHRQDGRERPY

What is claimed is:

1. A method of producing a mammalian oocyte carrying a modified target sequence in its genome, the method comprising the steps of introducing into a non-human, mammalian oocyte:
    (a) a clustered, regularly interspaced, short palindromic repeats (CRISPR)-associated protein 9 (Cas9 protein) or a nucleic acid molecule encoding said Cas9 protein; and
    (b-i) a target sequence specific CRISPR RNA (crRNA) and a trans-activating crRNA (tracr RNA) or one or more nucleic acid molecules encoding said RNAs; or
    (b-ii) a chimaeric RNA sequence comprising a target sequence specific crRNA and tracrRNA or a nucleic acid molecule encoding said RNA;
    wherein the Cas9 protein introduced in or encoded in (a) has an amino acid sequence as shown in SEQ ID NO: 2 and
    wherein the Cas9 protein introduced in or encoded in (a) and the RNA sequence(s) introduced in (b-i) or (b-ii) form a protein/RNA complex that specifically binds to the target sequence and introduces a single or double strand break within the target sequence.

2. The method of claim 1, wherein the target sequence is modified by homologous recombination with a donor nucleic acid sequence further comprising the step:
    (c) introducing a nucleic acid molecule into the oocyte, wherein the nucleic acid molecule comprises the donor nucleic acid sequence and regions homologous to the target sequence.

3. The method of claim 2, wherein the nucleic acid molecule is a single stranded oligodeoxynucleotide.

4. The method of claim 1, wherein the oocyte is a fertilized oocyte.

5. The method of claim 2, wherein the oocyte is a fertilized oocyte.

6. The method of claim 1, wherein the Cas9 protein or the nucleic acid molecule encoding same and/or the RNA of (b-i) or (b-ii) or the nucleic acid molecule encoding said RNA is/are introduced into the oocyte by microinjection.

7. The method of claim 2, wherein the Cas9 protein or the nucleic acid molecule encoding the same and/or the RNA of (b-i) or (b-ii) or the nucleic acid molecule encoding said RNA is/are introduced into the oocyte by microinjection.

8. The method of claim 2, wherein the nucleic acid molecule of (c) is introduced into the oocyte by microinjection.

9. The method of claim 1, wherein the nucleic acid molecule encoding the Cas9 protein is mRNA.

10. The method of claim 2, wherein the nucleic acid molecule encoding the Cas9 protein is mRNA.

11. The method of claim 2, wherein the regions homologous to the target sequence are localized at the 5' and 3' end of the donor nucleic acid sequence.

12. The method of claim 2, wherein the regions homologous to the target sequence comprised in the nucleic acid molecule of (c) have a length of at least 400 bp.

13. The method of claim 1, wherein the modification of the target sequence is selected from the group consisting of substitution, insertion and deletion of a least one nucleotide of the target sequence.

14. The method of claim 2, wherein the modification of the target sequence is selected from the group consisting of substitution, insertion and deletion of a least one nucleotide of the target sequence.

15. The method of claim 1, wherein the oocyte is from a non-human mammal selected from the group consisting of rodents, dogs, felines, primates, rabbits, pigs, and ruminants.

16. The method of claim 2, wherein the oocyte is from a non-human mammal selected from the group consisting of rodents, dogs, felines, primates, rabbits, pigs, and ruminants.

17. The method of claim 2, the method further comprising:
    (a) transferring an oocyte produced according to the method of claim 2 to a pseudopregnant female host; and
    (b) analyzing offspring delivered by the female host for the presence of the modification.

18. The method of claim 17, wherein the mammal and the host are non-human mammals selected from the group consisting of rodents, dogs, felines, primates, rabbits, pigs and ruminants.

19. The method of claim 17, wherein the oocyte is a fertilized oocyte.

20. The method of claim 18, wherein the oocyte is a fertilized oocyte.

* * * * *

UNITED STATES PATENT AND TRADEMARK OFFICE
CERTIFICATE OF CORRECTION

PATENT NO. : 9,783,780 B2  
APPLICATION NO. : 14/836231  
DATED : October 10, 2017  
INVENTOR(S) : Kühn et al.

Page 1 of 1

It is certified that error appears in the above-identified patent and that said Letters Patent is hereby corrected as shown below:

On the Title Page

Item (71) should read: HELMHOLTZ ZENTRUM MÜNCHEN DEUTSCHES FORSCHUNGSZENTRUM FÜR GESUNDHEIT UND UMWELT (GMBH), Neuherberg, (DE)

Item (73) should read: HELMHOLTZ ZENTRUM MÜNCHEN DEUTSCHES FORSCHUNGSZENTRUM FÜR GESUNDHEIT UND UMWELT (GMBH), Neuherberg, (DE)

Signed and Sealed this  
Thirty-first Day of August, 2021

Drew Hirshfeld  
*Performing the Functions and Duties of the*  
*Under Secretary of Commerce for Intellectual Property and*  
*Director of the United States Patent and Trademark Office*